United States Patent
Bernett et al.

(10) Patent No.: US 11,312,770 B2
(45) Date of Patent: Apr. 26, 2022

(54) BISPECIFIC AND MONOSPECIFIC ANTIBODIES USING NOVEL ANTI-PD-1 SEQUENCES

(71) Applicant: Xencor, Inc., Monrovia, CA (US)

(72) Inventors: Matthew Bernett, Monrovia, CA (US); Gregory Moore, Azusa, CA (US); John Desjarlais, Pasadena, CA (US); Michael Hedvat, Encino, CA (US); Christine Bonzon, Los Angeles, CA (US); Alex Nisthal, Monrovia, CA (US); Umesh Muchhal, Monrovia, CA (US)

(73) Assignee: Xencor, Inc., Monrovia, CA (US)

( * ) Notice: Subject to any disclaimer, the term of this patent is extended or adjusted under 35 U.S.C. 154(b) by 283 days.

(21) Appl. No.: 16/184,895

(22) Filed: Nov. 8, 2018

(65) Prior Publication Data

US 2019/0263909 A1     Aug. 29, 2019

Related U.S. Application Data

(60) Provisional application No. 62/658,227, filed on Apr. 16, 2018, provisional application No. 62/598,938, filed on Dec. 14, 2017, provisional application No. 62/583,438, filed on Nov. 8, 2017.

(51) Int. Cl.
| | |
|---|---|
| *C07K 16/28* | (2006.01) |
| *A61P 35/00* | (2006.01) |
| *C07K 16/46* | (2006.01) |
| *A61K 39/395* | (2006.01) |
| *A61K 39/00* | (2006.01) |

(52) U.S. Cl.
CPC .... *C07K 16/2818* (2013.01); *A61K 39/39541* (2013.01); *A61P 35/00* (2018.01); *C07K 16/2803* (2013.01); *C07K 16/2896* (2013.01); *C07K 16/468* (2013.01); *A61K 2039/505* (2013.01); *C07K 2317/31* (2013.01); *C07K 2317/51* (2013.01); *C07K 2317/515* (2013.01); *C07K 2317/524* (2013.01); *C07K 2317/526* (2013.01); *C07K 2317/622* (2013.01); *C07K 2317/76* (2013.01); *C07K 2317/92* (2013.01)

(58) Field of Classification Search
None
See application file for complete search history.

(56) References Cited

U.S. PATENT DOCUMENTS

| | | | |
|---|---|---|---|
| 3,773,919 A | 11/1973 | Boswell et al. | |
| 4,169,888 A | 10/1979 | Hanka et al. | |
| 4,179,337 A | 12/1979 | Davis et al. | |
| 4,256,746 A | 3/1981 | Miyashita et al. | |
| 4,294,757 A | 10/1981 | Asai | |
| 4,301,144 A | 11/1981 | Iwashita et al. | |
| 4,307,016 A | 12/1981 | Asai et al. | |
| 4,313,946 A | 2/1982 | Powell et al. | |
| 4,315,929 A | 2/1982 | Freedman et al. | |
| 4,322,348 A | 3/1982 | Asai et al. | |
| 4,331,598 A | 5/1982 | Hasegawa et al. | |
| 4,361,650 A | 5/1982 | Asai et al. | |
| 4,362,663 A | 12/1982 | Kida et al. | |
| 4,364,866 A | 12/1982 | Asai et al. | |
| 4,364,935 A | 12/1982 | Kung et al. | |
| 4,371,533 A | 2/1983 | Akimoto et al. | |
| 4,424,219 A | 1/1984 | Hashimoto et al. | |
| 4,450,254 A | 5/1984 | Isley et al. | |
| 4,496,689 A | 1/1985 | Mitra | |
| 4,640,835 A | 2/1987 | Shimizu et al. | |
| 4,670,417 A | 6/1987 | Iwasaki et al. | |
| 4,791,192 A | 12/1988 | Nakagawa et al. | |
| 4,880,935 A | 11/1989 | Thorpe | |
| 4,923,990 A | 5/1990 | Nakano et al. | |
| 4,943,533 A | 7/1990 | Mendelsohn et al. | |
| 4,970,198 A | 11/1990 | Lee et al. | |
| 5,053,394 A | 10/1991 | Ellestad et al. | |
| 5,070,092 A | 12/1991 | Kanda et al. | |
| 5,084,468 A | 1/1992 | Saito et al. | |
| 5,101,038 A | 3/1992 | Nakano et al. | |
| 5,122,368 A | 6/1992 | Greenfield et al. | |
| 5,187,186 A | 2/1993 | Kanda et al. | |
| 5,208,020 A | 5/1993 | Chari et al. | |
| 5,264,586 A | 11/1993 | Nicolaou et al. | |
| 5,384,412 A | 1/1995 | Nicolaou et al. | |
| 5,416,064 A | 5/1995 | Chari et al. | |
| 5,475,092 A | 12/1995 | Chari et al. | |
| 5,500,362 A | 3/1996 | Robinson et al. | |
| 5,530,101 A | 6/1996 | Queen et al. | |
| 5,541,087 A | 7/1996 | Lo et al. | |
| 5,550,246 A | 8/1996 | Nicolaou et al. | |
| 5,558,864 A | 9/1996 | Bendig et al. | |
| 5,585,089 A | 12/1996 | Queen et al. | |

(Continued)

FOREIGN PATENT DOCUMENTS

| | | |
|---|---|---|
| EP | 0425235 B1 | 9/1996 |
| EP | 1752471 | 2/2007 |

(Continued)

OTHER PUBLICATIONS

Callahan et al. (Journal of Leukocyte Biology, 94:41-53, 2013).*

(Continued)

*Primary Examiner* — Nelson B Moseley, II

(74) *Attorney, Agent, or Firm* — Christopher J. Betti; Morgan, Lewis & Bockius, LLP

(57) ABSTRACT

The present invention is directed to bispecific, heterodimeric checkpoint antibodies.

4 Claims, 288 Drawing Sheets

Specification includes a Sequence Listing.

(56) References Cited

U.S. PATENT DOCUMENTS

| | | |
|---|---|---|
| 5,585,097 A | 12/1996 | Bolt et al. |
| 5,585,499 A | 12/1996 | Chari et al. |
| 5,622,929 A | 4/1997 | Willner et al. |
| 5,635,483 A | 6/1997 | Pettit et al. |
| 5,641,780 A | 6/1997 | Amishiro et al. |
| 5,663,149 A | 9/1997 | Pettit et al. |
| 5,677,171 A | 10/1997 | Hudziak et al. |
| 5,693,761 A | 12/1997 | Queen et al. |
| 5,693,762 A | 12/1997 | Queen et al. |
| 5,703,080 A | 12/1997 | Nakakura et al. |
| 5,712,374 A | 1/1998 | Kuntsmann et al. |
| 5,714,586 A | 2/1998 | Kuntsmann et al. |
| 5,726,044 A | 3/1998 | Lo et al. |
| 5,731,168 A | 3/1998 | Carter et al. |
| 5,736,137 A | 4/1998 | Anderson et al. |
| 5,739,116 A | 4/1998 | Hamann et al. |
| 5,767,237 A | 6/1998 | Sakakibara et al. |
| 5,767,285 A | 6/1998 | Hamann et al. |
| 5,770,701 A | 6/1998 | McGahren et al. |
| 5,770,710 A | 6/1998 | McGahren et al. |
| 5,773,001 A | 6/1998 | Hamann et al. |
| 5,780,588 A | 7/1998 | Pettit et al. |
| 5,807,706 A | 9/1998 | Carter et al. |
| 5,821,333 A | 10/1998 | Carter et al. |
| 5,821,337 A | 10/1998 | Carter et al. |
| 5,824,805 A | 10/1998 | King et al. |
| 5,846,545 A | 12/1998 | Chari et al. |
| 5,859,205 A | 1/1999 | Adair et al. |
| 5,877,291 A | 3/1999 | Mezes et al. |
| 5,877,296 A | 3/1999 | Hamann et al. |
| 5,891,996 A | 4/1999 | Mateo de Acosta del Rio et al. |
| 5,892,020 A | 4/1999 | Mezes et al. |
| 5,945,311 A | 8/1999 | Lindhofer et al. |
| 5,968,509 A | 10/1999 | Gorman et al. |
| 6,054,297 A | 4/2000 | Carter et al. |
| 6,071,515 A | 6/2000 | Mezes et al. |
| 6,124,431 A | 9/2000 | Sakakibara et al. |
| 6,180,370 B1 | 1/2001 | Queen et al. |
| 6,214,345 B1 | 4/2001 | Firestone et al. |
| 6,235,883 B1 | 5/2001 | Jakobovits et al. |
| 6,329,507 B1 | 12/2001 | Mezes et al. |
| 6,407,213 B1 | 6/2002 | Carter et al. |
| 6,441,163 B1 | 8/2002 | Chari et al. |
| 6,455,677 B1 | 9/2002 | Park et al. |
| 6,506,883 B2 | 1/2003 | Meteo de Acosta del Rio et al. |
| 6,602,684 B1 | 8/2003 | Umana et al. |
| 6,632,927 B2 | 10/2003 | Adair et al. |
| 6,706,265 B1 | 3/2004 | Bolt et al. |
| 6,716,410 B1 | 4/2004 | Witztum |
| 6,723,538 B2 | 4/2004 | Mack et al. |
| 6,884,869 B2 | 4/2005 | Senter et al. |
| 6,989,452 B2 | 1/2006 | Ng et al. |
| 7,087,600 B2 | 8/2006 | Ng et al. |
| 7,112,324 B1 | 9/2006 | Dorken et al. |
| 7,129,261 B2 | 10/2006 | Ng et al. |
| 7,276,497 B2 | 10/2007 | Chari et al. |
| 7,303,749 B1 | 12/2007 | Chari |
| 7,368,565 B2 | 5/2008 | Chari et al. |
| 7,498,302 B2 | 3/2009 | Ng et al. |
| 7,507,420 B2 | 3/2009 | Ng et al. |
| 7,517,903 B2 | 4/2009 | Chen et al. |
| 7,601,354 B2 | 10/2009 | Chari |
| 7,642,228 B2 | 1/2010 | Carter et al. |
| 7,691,962 B2 | 4/2010 | Boyd et al. |
| 7,695,936 B2 | 4/2010 | Carter et al. |
| 7,696,338 B2 | 4/2010 | Neville, Jr. et al. |
| 7,728,114 B2 | 6/2010 | Mach et al. |
| 8,063,187 B2 | 11/2011 | Chu et al. |
| 8,114,967 B2 | 2/2012 | Bhatt et al. |
| 8,216,805 B2 | 7/2012 | Carter et al. |
| 8,236,308 B2 | 8/2012 | Kischel et al. |
| 8,309,690 B2 | 11/2012 | Allan et al. |
| 8,367,805 B2 | 2/2013 | Chamberlain et al. |
| 8,409,568 B2 | 4/2013 | Gao et al. |
| 8,592,562 B2 | 11/2013 | Kannan et al. |
| 8,637,641 B2 | 1/2014 | Dahiyat et al. |
| 8,946,387 B2 | 2/2015 | Koenig et al. |
| 9,822,181 B2 | 11/2017 | Bonvini et al. |
| 9,856,327 B2 | 1/2018 | Bernett et al. |
| 10,787,518 B2 | 9/2020 | Bernett et al. |
| 2001/0035606 A1 | 11/2001 | Schoen |
| 2002/0076406 A1 | 6/2002 | Leung |
| 2002/0103345 A1 | 8/2002 | Zhu |
| 2002/0131968 A1 | 9/2002 | Waldmann et al. |
| 2003/0003097 A1 | 1/2003 | Reff et al. |
| 2003/0017979 A1 | 1/2003 | Mack et al. |
| 2003/0091561 A1 | 5/2003 | Van de Winekl |
| 2003/0157108 A1 | 8/2003 | Presta |
| 2003/0223999 A1 | 12/2003 | Lindhofer |
| 2004/0018191 A1 | 1/2004 | Wang |
| 2004/0071696 A1 | 4/2004 | Adams et al. |
| 2004/0162411 A1 | 8/2004 | Lanzavecchia |
| 2004/0170626 A1 | 9/2004 | Schuurman |
| 2004/0242851 A1 | 12/2004 | Zhu |
| 2005/0114037 A1 | 5/2005 | Desjarlais et al. |
| 2005/0136050 A1 | 6/2005 | Kufer et al. |
| 2005/0142133 A1 | 6/2005 | Lazar et al. |
| 2005/0176028 A1 | 8/2005 | Hofmeiser et al. |
| 2005/0191702 A1 | 9/2005 | Mack et al. |
| 2005/0238648 A1 | 10/2005 | Jacobs |
| 2005/0238649 A1 | 10/2005 | Doronina |
| 2006/0008883 A1 | 1/2006 | Lazar |
| 2006/0018897 A1 | 1/2006 | Lee et al. |
| 2006/0024298 A1 | 2/2006 | Lazar et al. |
| 2006/0024317 A1 | 2/2006 | Boyd |
| 2006/0073142 A1 | 4/2006 | Chan et al. |
| 2006/0074008 A1 | 4/2006 | Senter |
| 2006/0115481 A1 | 6/2006 | Lindhofer et al. |
| 2006/0121032 A1 | 6/2006 | Dahiyat et al. |
| 2006/0134105 A1 | 6/2006 | Lazar et al. |
| 2006/0235208 A1 | 10/2006 | Lazar |
| 2007/0071675 A1 | 3/2007 | Wu et al. |
| 2007/0105199 A1 | 5/2007 | Yan et al. |
| 2007/0123479 A1 | 5/2007 | Kufer et al. |
| 2007/0148170 A1 | 6/2007 | Desjarlais |
| 2007/0287170 A1 | 12/2007 | Davis et al. |
| 2008/0044413 A1 | 2/2008 | Hammond et al. |
| 2008/0050370 A1 | 2/2008 | Glaser et al. |
| 2008/0138335 A1 | 6/2008 | Takahashi et al. |
| 2008/0213273 A1 | 9/2008 | Burge |
| 2008/0219974 A1 | 9/2008 | Bernett et al. |
| 2008/0242845 A1 | 10/2008 | Lazar et al. |
| 2009/0082213 A1 | 3/2009 | Horowitz et al. |
| 2009/0163699 A1 | 6/2009 | Desjarlais |
| 2009/0214539 A1 | 8/2009 | Grosmaire et al. |
| 2009/0252683 A1 | 10/2009 | Kischel et al. |
| 2009/0252729 A1 | 10/2009 | Farrington et al. |
| 2009/0274692 A1 | 11/2009 | Tan et al. |
| 2009/0311253 A1 | 12/2009 | Ghayur et al. |
| 2009/0317869 A1 | 12/2009 | Alley et al. |
| 2010/0004431 A1 | 1/2010 | Bernett et al. |
| 2010/0015133 A1 | 1/2010 | Igawa et al. |
| 2010/0080814 A1 | 4/2010 | Desjarlais et al. |
| 2010/0150918 A1 | 6/2010 | Kufer et al. |
| 2010/0174053 A1 | 7/2010 | Johnson et al. |
| 2010/0178298 A1 | 7/2010 | Lindhofer |
| 2010/0183554 A1 | 7/2010 | Mach et al. |
| 2010/0226925 A1 | 9/2010 | Dillon et al. |
| 2010/0239567 A1 | 9/2010 | Esue |
| 2010/0239582 A1 | 9/2010 | Humphreys et al. |
| 2010/0256339 A1 | 10/2010 | Bossenmaier et al. |
| 2010/0256340 A1 | 10/2010 | Brinkmann et al. |
| 2010/0298542 A1 | 11/2010 | Igawa et al. |
| 2010/0322933 A1 | 12/2010 | Lindhofer et al. |
| 2010/0330089 A1 | 12/2010 | Damle et al. |
| 2010/0331527 A1 | 12/2010 | Davis et al. |
| 2011/0054151 A1 | 3/2011 | Lazar et al. |
| 2011/0076275 A1 | 3/2011 | Igawa et al. |
| 2011/0177500 A1 | 7/2011 | Winther et al. |
| 2011/0189178 A1 | 8/2011 | Desjarlais et al. |
| 2011/0189209 A1 | 8/2011 | Neville, Jr. et al. |
| 2011/0201032 A1 | 8/2011 | Zeng et al. |
| 2011/0217302 A1 | 9/2011 | Odegard et al. |
| 2011/0262439 A1 | 10/2011 | Kufer et al. |

(56) References Cited

U.S. PATENT DOCUMENTS

| | | |
|---|---|---|
| 2011/0275787 A1 | 11/2011 | Kufer et al. |
| 2011/0293619 A1 | 12/2011 | Kufer et al. |
| 2012/0028304 A1 | 2/2012 | Dahiyat et al. |
| 2012/0034228 A1 | 2/2012 | Kufer et al. |
| 2012/0121597 A1 | 5/2012 | Ho et al. |
| 2012/0149876 A1 | 6/2012 | Von Kreudenstein et al. |
| 2012/0156207 A1 | 6/2012 | Chu et al. |
| 2012/0251531 A1 | 10/2012 | Baehner et al. |
| 2012/0251541 A1 | 10/2012 | Baurin et al. |
| 2013/0089541 A1 | 4/2013 | D'Angelo et al. |
| 2013/0095097 A1 | 4/2013 | Blakenship et al. |
| 2013/0101586 A1 | 4/2013 | Riegler et al. |
| 2013/0115208 A1 | 5/2013 | Ho et al. |
| 2013/0129723 A1 | 5/2013 | Blakenship et al. |
| 2013/0142793 A1 | 6/2013 | Ledbetter et al. |
| 2013/0171095 A1 | 7/2013 | Bernett et al. |
| 2013/0195849 A1 | 8/2013 | Von Kreudenstein et al. |
| 2013/0209355 A1 | 8/2013 | De Weers et al. |
| 2013/0267686 A1 | 10/2013 | Brinkmann |
| 2013/0336981 A1 | 12/2013 | de Kruif et al. |
| 2014/0024111 A1 | 1/2014 | Kannan et al. |
| 2014/0056879 A1 | 2/2014 | Lazar |
| 2014/0072581 A1 | 3/2014 | Dixit et al. |
| 2014/0086916 A1 | 3/2014 | Zha |
| 2014/0212435 A1 | 7/2014 | Moore et al. |
| 2014/0212436 A1 | 7/2014 | Moore et al. |
| 2014/0249297 A1 | 9/2014 | Lazar et al. |
| 2014/0288275 A1 | 9/2014 | Moore et al. |
| 2014/0294759 A1 | 10/2014 | Chu et al. |
| 2014/0294823 A1 | 10/2014 | Moore et al. |
| 2014/0294833 A1 | 10/2014 | Desjarlais et al. |
| 2014/0294835 A1 | 10/2014 | Moore et al. |
| 2014/0294836 A1 | 10/2014 | Chu et al. |
| 2014/0302064 A1 | 10/2014 | Moore |
| 2014/0322217 A1 | 10/2014 | Moore et al. |
| 2014/0356381 A1 | 12/2014 | Moore et al. |
| 2014/0363426 A1* | 12/2014 | Moore ............ C07K 16/2809 424/133.1 |
| 2014/0370013 A1 | 12/2014 | Desjarlais et al. |
| 2014/0370020 A1 | 12/2014 | Kuramochi et al. |
| 2014/0377269 A1 | 12/2014 | Mabry et al. |
| 2014/0377270 A1 | 12/2014 | Moore et al. |
| 2015/0071948 A1 | 3/2015 | Lazar et al. |
| 2015/0259420 A1* | 9/2015 | Triebel ................ A61P 35/00 424/136.1 |
| 2015/0307629 A1 | 10/2015 | Bernett et al. |
| 2016/0060360 A1 | 3/2016 | Moore et al. |
| 2016/0068588 A1 | 3/2016 | Bernett et al. |
| 2016/0176969 A1 | 6/2016 | Bernett et al. |
| 2016/0215063 A1 | 7/2016 | Bernett et al. |
| 2016/0229924 A1 | 8/2016 | Bernett et al. |
| 2017/0020963 A1 | 1/2017 | Qu et al. |
| 2018/0118828 A1 | 5/2018 | Bernett et al. |
| 2018/0127501 A1 | 5/2018 | Bernett et al. |
| 2018/0289771 A1 | 10/2018 | Shan et al. |
| 2019/0382495 A1 | 12/2019 | Bernett et al. |
| 2019/0389954 A1 | 12/2019 | Bernett et al. |

FOREIGN PATENT DOCUMENTS

| | | |
|---|---|---|
| EP | 1829895 | 5/2007 |
| EP | 2006381 | 12/2008 |
| EP | 2009101 A1 | 12/2008 |
| EP | 2194066 | 6/2010 |
| EP | 2202245 A1 | 6/2010 |
| EP | 2522724 | 6/2011 |
| EP | 2155788 | 2/2014 |
| EP | 3252078 | 12/2017 |
| WO | WO8705330 | 9/1987 |
| WO | WO9211018 | 7/1992 |
| WO | WO9321232 | 10/1993 |
| WO | WO9413804 | 5/1994 |
| WO | WO9520045 | 1/1995 |
| WO | WO9640210 | 6/1996 |
| WO | WO96027011 | 9/1996 |
| WO | WO98050431 | 11/1998 |
| WO | WO199937791 | 7/1999 |
| WO | WO99054440 | 10/1999 |
| WO | WO99066951 | 12/1999 |
| WO | WO200061739 A1 | 10/2000 |
| WO | WO200124763 A2 | 4/2001 |
| WO | WO200129246 A1 | 4/2001 |
| WO | WO200162931 A1 | 8/2001 |
| WO | WO200188138 | 11/2001 |
| WO | WO2001083525 | 11/2001 |
| WO | WO2001090192 | 11/2001 |
| WO | WO200216368 | 2/2002 |
| WO | WO200230954 A1 | 4/2002 |
| WO | WO200231140 A1 | 4/2002 |
| WO | WO2002088172 A2 | 7/2002 |
| WO | WO2002062850 | 8/2002 |
| WO | WO2002083180 | 10/2002 |
| WO | WO2002098883 | 12/2002 |
| WO | WO2004010957 | 2/2004 |
| WO | WO2004043493 | 5/2004 |
| WO | WO2004103272 | 12/2004 |
| WO | WO2004106383 | 12/2004 |
| WO | WO2005063816 | 7/2005 |
| WO | WO2005112919 A2 | 12/2005 |
| WO | WO2005118635 | 12/2005 |
| WO | WO2006020258 | 2/2006 |
| WO | WO2006034488 | 3/2006 |
| WO | WO2006036834 | 4/2006 |
| WO | WO2006072620 | 7/2006 |
| WO | WO2006110476 A2 | 10/2006 |
| WO | WO2006106905 | 12/2006 |
| WO | WO2007005612 | 1/2007 |
| WO | WO2007018431 A2 | 2/2007 |
| WO | WO2007033230 | 3/2007 |
| WO | WO2007042261 | 4/2007 |
| WO | WO2007046006 | 4/2007 |
| WO | WO2007047829 | 4/2007 |
| WO | WO2007059404 A2 | 5/2007 |
| WO | WO2007062037 | 5/2007 |
| WO | WO2007084342 | 7/2007 |
| WO | WO2007089149 A2 | 8/2007 |
| WO | WO2007093630 | 8/2007 |
| WO | WO2007098934 | 9/2007 |
| WO | WO2007110205 | 10/2007 |
| WO | WO2007113648 | 10/2007 |
| WO | WO20070147901 | 12/2007 |
| WO | WO2008003103 | 1/2008 |
| WO | WO2008003115 | 1/2008 |
| WO | WO2008003116 | 1/2008 |
| WO | WO2008119096 | 10/2008 |
| WO | WO2008119566 | 10/2008 |
| WO | WO2008124858 | 10/2008 |
| WO | WO2008145142 | 12/2008 |
| WO | WO2008150494 | 12/2008 |
| WO | WO2009000006 | 12/2008 |
| WO | WO2009017394 A1 | 2/2009 |
| WO | WO2009017823 | 2/2009 |
| WO | WO2009030734 | 3/2009 |
| WO | WO2009032782 | 3/2009 |
| WO | WO2009086320 | 7/2009 |
| WO | WO2009089004 | 7/2009 |
| WO | WO2009106096 | 9/2009 |
| WO | WO2009106321 | 9/2009 |
| WO | WO2010028796 | 3/2010 |
| WO | WO2010033736 | 3/2010 |
| WO | WO2010034441 | 4/2010 |
| WO | WO2010037835 | 4/2010 |
| WO | WO2010042904 | 4/2010 |
| WO | WO2010062171 A2 | 6/2010 |
| WO | WO2010085682 | 7/2010 |
| WO | WO2010106180 | 9/2010 |
| WO | WO2010115551 | 10/2010 |
| WO | WO2010115552 | 10/2010 |
| WO | WO2010115553 | 10/2010 |
| WO | WO2010115589 | 10/2010 |
| WO | WO2010119119 | 10/2010 |
| WO | WO20100112193 | 10/2010 |
| WO | WO2010136172 | 12/2010 |

(56) References Cited

FOREIGN PATENT DOCUMENTS

| | | |
|---|---|---|
| WO | WO2010151792 | 12/2010 |
| WO | WO2010151808 | 12/2010 |
| WO | WO2011005621 | 1/2011 |
| WO | WO2011028952 | 3/2011 |
| WO | WO2011036183 | 3/2011 |
| WO | WO2011066342 | 3/2011 |
| WO | WO2011051307 | 5/2011 |
| WO | WO2011063348 | 5/2011 |
| WO | WO2011066501 | 6/2011 |
| WO | WO2011121110 | 10/2011 |
| WO | WO2011131746 | 10/2011 |
| WO | WO2011133886 | 10/2011 |
| WO | WO2011143545 | 11/2011 |
| WO | WO2011159877 | 12/2011 |
| WO | WO2012016227 | 2/2012 |
| WO | WO2012018687 | 2/2012 |
| WO | WO2012032080 | 3/2012 |
| WO | WO2012058768 | 5/2012 |
| WO | WO2012062596 | 5/2012 |
| WO | WO2012107417 | 8/2012 |
| WO | WO2012116453 | 9/2012 |
| WO | WO2012125495 | 9/2012 |
| WO | WO2012125850 | 9/2012 |
| WO | WO2012131555 | 10/2012 |
| WO | WO2012146394 | 11/2012 |
| WO | WO2012146628 | 11/2012 |
| WO | WO2012162067 | 11/2012 |
| WO | WO2013006544 | 1/2013 |
| WO | WO2013016714 | 1/2013 |
| WO | WO2013022855 | 2/2013 |
| WO | WO2013026833 | 2/2013 |
| WO | WO2013033008 | 3/2013 |
| WO | WO2013047748 | 4/2013 |
| WO | WO2013055809 | 4/2013 |
| WO | WO2013063702 | 5/2013 |
| WO | WO2013096828 | 6/2013 |
| WO | WO2013125667 | 8/2013 |
| WO | WO2013164694 | 11/2013 |
| WO | WO2013180201 | 12/2013 |
| WO | WO2014004586 | 1/2014 |
| WO | WO2014012085 | 1/2014 |
| WO | WO2014047231 | 3/2014 |
| WO | WO2014056783 | 4/2014 |
| WO | WO2014079000 | 5/2014 |
| WO | WO2014110601 | 7/2014 |
| WO | WO2014113510 | 7/2014 |
| WO | WO2014145806 | 9/2014 |
| WO | WO2014145907 | 9/2014 |
| WO | WO2014164553 | 10/2014 |
| WO | WO2014207064 | 12/2014 |
| WO | WO2014209804 | 12/2014 |
| WO | WO2015018528 | 2/2015 |
| WO | WO2015026892 | 2/2015 |
| WO | WO2015063339 | 5/2015 |
| WO | WO2015095392 | 6/2015 |
| WO | WO2015095410 | 6/2015 |
| WO | WO2015095423 | 6/2015 |
| WO | WO2015103072 | 7/2015 |
| WO | WO2015143079 | 9/2015 |
| WO | WO2015149077 | 10/2015 |
| WO | WO2015168379 | 11/2015 |
| WO | WO2015184207 | 12/2015 |
| WO | WO2016014984 | 1/2016 |
| WO | WO2016028672 | 2/2016 |
| WO | WO2016028896 | 2/2016 |
| WO | WO2016079050 | 5/2016 |
| WO | WO2016086186 | 6/2016 |
| WO | WO2016086189 | 6/2016 |
| WO | WO2016086196 | 6/2016 |
| WO | WO2016105450 | 6/2016 |
| WO | WO2016110584 | 7/2016 |
| WO | WO2016115274 | 7/2016 |
| WO | WO2016120789 | 8/2016 |
| WO | WO2016141387 | 9/2016 |
| WO | WO2016182751 | 11/2016 |
| WO | WO2017019846 | 2/2017 |
| WO | WO2017112775 | 6/2017 |
| WO | WO2017210443 | 12/2017 |
| WO | WO2017210485 | 12/2017 |
| WO | WO2017214092 | 12/2017 |
| WO | WO2019050521 | 3/2019 |

OTHER PUBLICATIONS

U.S. Appl. No. 12/875,015, 2011-0054151, U.S. Pat. No. 9,493,578, Granted, filed Sep. 2, 2010, Mar. 3, 2011, Nov. 15, 2016.
U.S. Appl. No. 15/279,266, 2017-0058053, Abandoned, filed Sep. 28, 2016, Mar. 2, 2017.
U.S. Appl. No. 16/539,986, Pending, filed Aug. 13, 2019.
U.S. Appl. No. 13/648,951, 2013-0171095, Published, filed Oct. 10, 2012, Jul. 4, 2013.
U.S. Appl. No. 13/194,904, 2012-0028304, U.S. Pat. No. 8,637,641, Granted, filed Jul. 29, 2011, Feb. 2, 2012, Jan. 28, 2014.
U.S. Appl. No. 14/165,487, 2014-0249297, U.S. Pat. No. 9,605,061, Granted, filed Jan. 27, 2014, Sep. 4, 2014, Mar. 28, 2017.
U.S. Appl. No. 15/444,087, 2017-0174757, To Be Aband, filed Feb. 27, 2017, Jun. 22, 2017.
U.S. Appl. No. 13/568,028, Abandoned, filed Aug. 6, 2012.
U.S. Appl. No. 14/853,622, 2016-0068588, Published, filed Sep. 14, 2015, Mar. 10, 2016.
U.S. Appl. No. 13/887,234, Abandoned, filed May 3, 2013.
U.S. Appl. No. 14/156,431, 2014-0212435, Abandoned, filed Jan. 15, 2014, Jul. 15, 2014.
U.S. Appl. No. 14/156,432, 2014-0212436, U.S. Pat. No. 9,738,722, Granted, filed Jan. 15, 2014, Jul. 31, 2014, Aug. 22, 2017.
U.S. Appl. No. 14/808,826, 2016-0060360, Abandoned, filed Jul. 24, 2015, Mar. 3, 2016.
U.S. Appl. No. 15/682,380, 2018-0201686, Abandoned, filed Aug. 21, 2017, Jul. 19, 2018.
U.S. Appl. No. 14/155,248, 2014-0322217, Allowed, filed Jan. 14, 2014, Oct. 30, 2014.
U.S. Appl. No. 14/155,334, 2014-0370013, Published, filed Jan. 14, 2014, Dec. 18, 2014.
U.S. Appl. No. 14/155,344, 2014-0294833, U.S. Pat. No. 9,701,759, Granted, filed Jan. 14, 2014, Oct. 2, 2014, Jul. 11, 2017.
U.S. Appl. No. 14/205,227, 2014-0294835, Abandoned, filed Mar. 11, 2014, Oct. 2, 2014.
U.S. Appl. No. 14/205,248, 2014-0288275, U.S. Pat. No. 9,650,446, Granted, filed Mar. 11, 2014, Sep. 25, 2014, May 16, 2017.
U.S. Appl. No. 15/589,908, 2018-0142040, Published, filed May 8, 2017, May 24, 2018.
U.S. Appl. No. 15/633,629, 2018-0215834, Allowed, filed Jun. 26, 2017, Aug. 2, 2018.
U.S. Appl. No. 14/214,418, 2014-0356381, U.S. Pat. No. 10,106,624, Granted, filed Mar. 14, 2014, Dec. 4, 2014, Oct. 23, 2018.
U.S. Appl. No. 16/137,389, Abandoned, filed Sep. 20, 2018.
U.S. Appl. No. 14/214,475, 2014-0294836, Allowed, filed Mar. 14, 2014, Oct. 2, 2014.
U.S. Appl. No. 14/217,166, 2014-0294759, Allowed, filed Mar. 17, 2014, Oct. 2, 2014.
U.S. Appl. No. 14/200,652, 2014-0302064, Published, filed Mar. 7, 2014, Oct. 9, 2014.
U.S. Appl. No. 14/207,489, 2014-0377270, U.S. Pat. No. 10,131,710, Granted, filed Mar. 12, 2014, Dec. 25, 2014, Nov. 20, 2018.
U.S. Appl. No. 16/162,172, 2019-0270810, Published, filed Oct. 16, 2018, Sep. 5, 2019.
U.S. Appl. No. 14/200,821, 2014-0294823, U.S. Pat. No. 9,605,084, Granted, filed Mar. 7, 2014, Oct. 2, 2014, Mar. 28, 2017.
U.S. Appl. No. 14/216,705, 2014-0363426, Published, filed Mar. 17, 2014, Dec. 11, 2014.
U.S. Appl. No. 15/444,026, 2018-0037668, U.S. Pat. No. 10,287,364, Granted, filed Feb. 27, 2017, Feb. 8, 2018, May 14, 2019.
U.S. Appl. No. 16/364,093, Pending, filed Mar. 25, 2019.
U.S. Appl. No. 14/673,695, 2015-0307629, Transferred, filed Mar. 30, 2015, Oct. 29, 2015.
U.S. Appl. No. 15/786,252, 2018-0094079, Published, filed Oct. 17, 2017, Apr. 5, 2018.

(56) References Cited

OTHER PUBLICATIONS

U.S. Appl. No. 14/952,705, 2016-0176969, Abandoned, filed Nov. 25, 2015, Jun. 23, 2016.
U.S. Appl. No. 14/952,714, 2016-0229924, Published, filed Nov. 25, 2015, Aug. 11, 2016.
U.S. Appl. No. 15/141,350, 2016-0355608, U.S. Pat. No. 10,259,887, Granted, filed Apr. 28, 2016, Dec. 8, 2016, Apr. 16, 2019.
U.S. Appl. No. 15/945,679, 2018-0282432, Published, filed Apr. 4, 2018, Oct. 4, 2018.
U.S. Appl. No. 15/945,681, 2018-0223000, Published, filed Apr. 4, 2018, Aug. 9, 2018.
U.S. Appl. No. 16/354,058, 2019-0202938, Published, filed Mar. 14, 2019, Jul. 4, 2019.
U.S. Appl. No. 14/952,786, 2016-0215063, Transferred, filed Nov. 25, 2015, Jul. 28, 2016.
U.S. Appl. No. 15/779,325, Pending, filed May 25, 2018.
U.S. Appl. No. 14/757,809, 2016-0355600, U.S. Pat. No. 10,428,155, Allowed, filed Dec. 22, 2015, Dec. 8, 2016, Oct. 1, 2019.
U.S. Appl. No. 16/530,946, Pending, filed Aug. 2, 2019.
U.S. Appl. No. 15/063,441, 2017-0037131, U.S. Pat. No. 10,227,411, Granted, filed Mar. 7, 2016, Feb. 9, 2017, Mar. 12, 2019.
U.S. Appl. No. 16/297,255, 2019-0194325, Published, filed Mar. 8, 2019, Jun. 27, 2019.
U.S. Appl. No. 15/372,360, 2017-0320947, U.S. Pat. No. 10,227,410, Granted, filed Dec. 7, 2016, Nov. 9, 2017, Mar. 12, 2019.
U.S. Appl. No. 16/489,539, Pending, filed Aug. 28, 2019.
U.S. Appl. No. 15/623,314, 2018-0118836, Published, filed Jun. 14, 2017, May 3, 2018.
U.S. Appl. No. 16/435,373, Pending, filed Jun. 7, 2019.
U.S. Appl. No. 16/435,375, Pending, filed Jun. 7, 2019.
U.S. Appl. No. 15/611,361, 2017-0349660, Published, filed Jun. 1, 2017, Dec. 7, 2017.
U.S. Appl. No. 15/611,683, 2017-0349657, Published, filed Jun. 1, 2017, Dec. 7, 2017.
U.S. Appl. No. 15/636,590, 2018-0118827, U.S. Pat. No. 10,316,088, Granted, filed Jun. 28, 2017, May 3, 2018, Jun. 11, 2019.
U.S. Appl. No. 16/393,900, 2019-0248898, Published, filed Apr. 24, 2019, Aug. 15, 2019.
U.S. Appl. No. 15/185,958, 2017-0081420, U.S. Pat. No. 9,850,320, Granted, filed Jun. 17, 2016, Mar. 23, 2017, Dec. 26, 2017.
U.S. Appl. No. 15/186,167, 2017-0081424, U.S. Pat. No. 9,856,327, Granted, filed Jun. 17, 2016, Mar. 23, 2017, Jan. 2, 2018.
U.S. Appl. No. 15/691,665, 2018-0127501, Published, filed Aug. 30, 2017, May 10, 2018.
U.S. Appl. No. 16/184,895, 2019-0263909, Published, filed Nov. 8, 2018, Aug. 29, 2019.
U.S. Appl. No. 16/184,929, 2019-0270816, Published, filed Nov. 8, 2018, Sep. 5, 2019.
U.S. Appl. No. 16/375,777, Pending, filed Apr. 4, 2019.
U.S. Appl. No. 12/631,508, filed Dec. 4, 2009, Chari et al.
(No Author Name) "A method for making multispecific antibodies having heteromultimeric and common components", Expert Opinion on Therapeutic Patents, Genentech, Inc. (1999) 9(6): 785-790, pp. 785-790.
"Polythene Glycol and Derivatives for Advanced PEGylation", Catalog 2005-2006, Nektar Therapeutics.
"Xencor Provides Data Updates on XmaB Bispecific Antibody Program and Announces Presentations at Upcoming American Society of Hematology 2014 Annual Meeting", Nov. 6, 2014, XP055255549, retrieved from the internet: http://files.shareholder.com/downloads/AMDA-2B2V8N/0x0x792404/77590b72-837a-4085-bc55-78fa500638dc/XNCR_News_2014_11_6_General_Releases.pdf.
Abbott Laboratories, Strategies and Current Approaches for Improving Drug-Like-Properties During Biologics Drug Candidate Selection, AAPS Webinar—Nov. 10, 2011.
Adams, et al., Avidity-Mediated Enhancement of In vivo Tumor Targeting by Single-Chain Fv Dimers, Clin Cancer Res, 2006, vol. 12(5), pp. 1599-1605, doi:10.1158/1078-0432.CCR-05-2217.
Alberola-Ila et al., Stimulation Through the TCR/CD3 Complex Up-Regulates the CD2 Srface Expression on Human T Lymphocytes, Feb. 15, 1991.
Alibaud et al., A New Monoclonal Anti-CD3? Antibody Reactive on Paraffin Sections, Journal of Histochemistry & Cytochemistry, 2000, vol. 48, p. 1609.
An, et al., IgG2m4, an engineered antibody isotype with reduced Fc function, mAbs, 2009, vol. 1, Issue 6, pp. 572-579, www.landesbioscience.com/journals/mabs/article/10185.
Aplin et al., , Preparation, properties, and applications of carbohydrate conjugates of proteins and lipids, 1981, CRC Crit. Rev. Biochem., pp. 259-306.
Arnett, et al., Crystal structure of a human CD3-ε/δ dimer in complex with a UCHT1 single-chain antibody fragment, PNAS, 2004, vol. 101, No. 46, pp. 16268-16273.
Asano, et al., Cytotoxic enhancement of a bispecific diabody (Db) by format conversion to tandem single-chain variable fragment (taFv): The Case of the hEx3 Diabody, JBC Papers in Press, 2010, http://www.jbc.org/cgi/doi/10.1074/jbc.M110.172957.
Asano, et al., Highly Effective Recombinant Format of a Humanized IgG-like Bispecific Antibody for Cancer Immunotherapy with Retargeting of Lymphocytes to Tumor Cells, The Journal of Biological Chemistry, 2007, vol. 282, No. 38, pp. 27659-27665.
Atwell, et al., Stable Heterodimers from Remodeling the Domain Interface of a Homodimer using a Phage Display Library, J. Mol. Biol., 1997, vol. 270, pp. 26-35.
Baca et al., Antibody humanization using monovalent phage display, 1997, J. Biol. Chem. 272(16):10678-10684.
Baeuerle, et al., Response to Letter, "Correct TandAb protein," Molecular Immunology, 2007, vol. 44, pp. 3084.
Baeuerle, et al., Review—Bispecific T-Cell Engaging Antibodies for Cancer Therapy, Cancer Res, 2009, vol. 69: (12), pp. 4941-4944.
Barbas, et al. In vitro evolution of a neutralizing human antibody to human immunodeficiency virus type 1 to enhance affinity and broaden strain cross-reactivity, 1994, Proc. Nat. Acad. Sci, USA 91:3809-3813.
Bargou et al., Tumor Regression in Cancer Patients by Very Low Doses of a T Cell-Engaging Antibody, Science, 2008, vol. 321, pp. 974-977.
Bhatt, Sea Lane—DDD presentation, "Surrobodies™—A Novel Approach to Bispecifics . . . ," Aug. 8, 2012.
Bibollet-Ruche et al., The Quality of Chimpanzee T-Cell Activation and Simian Immunodeficiency Virus/Human Immunodeficiency Virus Susceptibility Achieved via Antibody-Mediated T-Cell Receptor/CD3 Stimulation Is a Function of the Anti-CD3 Antibody Isotype, Jul. 30, 2008.
Biochemica, Your apoptosis specialist, 1999, No. 2, pp. 34-37 (Roche Molecular Biochemicals).
Bird et al., Single-chain antigen-binding proteins, 1988, Science 242:423-426.
Bluemel, et al., Epitope distance to the target cell membrane and antigen size determine the potency of T cell-mediated lysis by BiTE antibodies specific for a large melanoma surface antigen, Cancer Immunol Immunother, 2010, vol. 59(8), pp. 1197-1209.
Borras, et al., Generic Approach for the Generation of Stable Humanized Single-chain Fv Fragments from Rabbit Monoclonal Antibodies, The Journal of Biological Chemistry, 2010, vol. 285, No. 12, pp. 9054-9066.
Bortoletto, Nicola et al., "Optimizing anti-CD3 affinity for effective T cell targeting against tumor cells.", Eur J Immunol. Nov. 2002;32(11):3102-7.
Boswell et al., Effects of Charge on Antibody Tissue Distribution and Pharmacokinetics, 2010, Bioconjugate Chem, 21(21):2153-2163.
Brandl, et al., Bispecific antibody fragments with CD20 3 CD28 specificity allow effective autologous and allogeneic T-cell activation against malignant cells in peripheral blood and bone marrow cultures from patients with B-cell lineage leukemia and lymphoma, Experimental Hematology, 1999, vol. 27, pp. 1264-1270.
Brinkmann , et al., presentation slideshow—"Roche Penzberg & Roche Glycart, Schlieren: Centers of Excellence for Recombinant Proteins".

(56) References Cited

OTHER PUBLICATIONS

Brinkmann, et al., A recombinant immunotoxin containing a disulfide-stabilized Fv fragment, Proc. Natl. Acad. Sci. USA, 1993, vol. 90, pp. 7538-7542.
Cao, et al., Oligomerization is required for the activity of recombinant soluble LOX-1., FEBS J. Sep. 2009;276(17):4909-20. doi: 10.1111/j.1742-4658.2009.07190.x. Epub Jul. 31, 2009.
Carpenter, et al., Non-Fc Receptor-Binding Humanized Anti-CD3 Antibodies Induce Apoptosis of Activated Human T Cells, J. Immunol., 2000, vol. 165, No. 11, pp. 6205-6213.
Carter et al., Antibody-drug conjugates for cancer therapy, 2008, Cancer J. 14(3):154-169.
Carter et al., Humanization of an anti-p185HER2 antibody for human cancer therapy, 1992, Proc Natl Acad Sci USA 89:4285-9.
Castoldi, et al., Molecular characterization of novel trispecific ErbB-cMet-IGF1R antibodies and their antigen-binding properties, Protein Engineering, Design & Selection, 2012, vol. 25, No. 10, pp. 551-559.
Cemerski, et al., Suppression of mast cell degranulation through a dual-targeting tandem IgE-IgG Fc domain biologic engineered to bind with high affinity to FcγRIIb., Immunol Lett. Mar. 30, 2012;143(1):34-43. doi:10.1016/j.imlet.2012.01.008. Epub Jan. 25, 2012.
Chames et al., Bispecific antibodies for cancer therapy—The light at the end of the tunnel?, mAbs, 2009, vol. 1, Issue 6, pp. 1-9.
Chang, et al., Monoclonal antibodies against oxidized low-density lipoprotein bind to apoptotic cells and inhibit their phagocytosis by elicited macrophages: evidence that oxidation-specific epitopes mediate macrophage recognition., Proc Natl Acad Sci U S A. May 25, 1999;96(11):6353-8.
Chari et al., Immunoconjugates containing novel maytansinoids: promising anticancer drugs, 1992, Cancer Research 52: 127-131.
Chatal, 1989, Monoclonal Antibodies in Immunoscintigraphy, CRC Press (Book Abstract).
Chelius, et al., Structural and functional characterization of the trifunctional antibody catumaxomab, mAbs, 2010, vol. 2, Issue 3, pp. 309-319.
Chichili et al., A CD3×CD123 bispecific DART for redirecting host T cells to myelogenous leukemia: preclinical activity and safety in nonhuman primates., Sci Transl Med. May 27, 2015;7(289):289ra82. doi: 10.1126/scitranslmed.aaa5693.
Chothia et al., Canonical structures for the hypervariable regions of immunoglobulins, 1987, J. Mol. Biol. 196:901-917.
Chothia, et al., Structural Determinants in the Sequences of Immunoglobulin Variable Domain, J. Mol. Biol., 1998, vol. 278, pp. 457-479.
Chu et al., Immunotherapy with Long-Lived Anti-CD123×Anti-CD3 Bispecific Antibodies Stimulates Potent T Cell Mediated Killing of Human AML Cell Lines and of CD123+ Cells In Monkeys: A Potential Therapy for Acute Myelogenous Leukemia, Blood 2014, 124:2316.
Chu et al., Immunotherapy with Long-Lived Anti-CD123×Anti-CD3 Bispecific Antibodies Stimulates Potent T Cell-Mediated Killing of Human B Cell Lines and of Circulating and Lymphoid B Cells in Monkeys: A Potential Therapy for B Cell Lymphomas and Leukemias, Blood 2014, 124:3111.
Chu et al., Inhibition of B cell receptor-mediated activation of primary human B cells by coengagement of CD19 and FcgammaRIIb with Fc-engineered antibodies., Mol Immunol. Sep. 2008;45(15):3926-33. doi: 10.1016/j.molimm.2008.06.027. Epub Aug. 8, 2008.
Chu et al., Reduction of total IgE by targeted coengagement of IgE B-cell receptor and FcγRIIb with Fc-engineered antibody., J Allergy Clin Immunol. Apr. 2012;129(4):1102-15. doi: 10.1016/j.jaci.2011. 11.029. Epub Jan. 16, 2012.
Conrad, et al., TCR and CD3 Antibody Cross-Reactivity in 44 Species, Cytometry Part A, 2007, vol. 71A, pp. 925-933.
Conrath, et al., Antigen Binding and Solubility Effects upon the Veneering of a Camel VHH in Framework-2 to Mimic a VH, J. Mol. Biol. , 2005, vol. 350, pp. 112-125.

Counterman et al., "Volumes of Individual Amino Acid Residues in Gas-Phase Peptide Ions.", J. Am. Chem. Soc., 1999, 121 (16), pp. 4031-4039.
Cuesta, et al., Multivalent antibodies: when design surpasses evolution, Trends in Biotechnology, 2010, vol. 28, No. 7, pp. 355-362, doi:10.1016/j.tibtech.2010.03.007.
D'Argouges, et al., Combination of rituximab with blinatumomab (MT103/MEDI-538), a T cell-engaging CD19-/CD3-bispecific antibody, for highly efficient lysis of human B lymphoma cells, Leukemia Research, 2009, vol. 33, pp. 465-473.
Davies et al., Expression of GnTIII in recombinant anti-CD20 CHO production cell line: expression of antibodies with altered glycoforms leads to an increase in ADCC through higher affinity for FCγRIII, 2001, Biotechnol Bioeng 74:288-294.
Davila, et al., Efficacy and Toxicity Management of 19-28z CAR T Cell Therapy in B Cell Acute Lymphoblastic Leukemia, Sci. Transl. Med., 2014, vol. 6, Issue 224, pp. 1-10, 224ra25.
Davis, et al., SEEDbodies: fusion proteins based on strand-exchange engineered domain (SEED) $C_H3$ heterodimers in an Fc analogue platform for asymmetric binders or immunofusions and bispecific antibodies, Protein Engineering, Design & Selection, 2010, vol. 23, No. 4 pp. 195-202.
De Groot et al., De-Immunization Of Therapeutic Proteins By T-Cell Epitope Modification, 2005, Dev. In Biologicals, 2005, 122:171-194.
De Pascalis et al., Grafting of "abbreviated" complementarity-determining regions containing specificity-determining residues essential for ligand contact to engineer a less immunogenic humanized monoclonal antibody, 2002, J. Immunol. 169:3076-3084.
Del Nagro et al., A critical role for complement C3d and the B cell coreceptor (CD19/CD21) complex in the initiation of inflammatory arthritis., J. Immunol. Oct. 15, 2005;175(8):5379-89.
Demarest et al., Antibody therapeutics, antibody engineering, and the merits of protein stability, Current Opinin in Drug Discovery & Development, 2008 11(5): 675-587, Sep. 11, 2008.
Deyev, et al., Multivalency: the hallmark of antibodies used for optimization of tumor targeting by design, BioEssays, 2008, vol. 30, pp. 904-918.
DiGiammarino et al., Ligand association rates to the inner-variable-domain of a dual-variable-domain immunoglobulin are significantly impacted by linker design, mAbs3:5, 1-8; Sep.-Oct.; 3(5):487-94, Landes Bioscience, Sep. 1, 2011.
DiGiandomenico et al., A multifunctional bispecific antibody protects against Pseudomonas aeruginosa., Sci Transl Med. Nov. 12, 2014;6(262):262ra155. doi: 10.1126/scitranslmed.3009655.
Dixon, et al., Activation of Human T Lymphocytes by Crosslinking of Anti-CD3 Monoclonal Antibodies, Journal of Leukocyte Biology, 1989, vol. 46, pp. 214-220.
Dong et al., A stable IgG-like bispecific antibody targeting the epidermal growth factor receptor and the type I insulin-like growth factor receptor demonstrates superior anti-tumor activity, mAbs 3:3, May-Jun. 2011: 273-288, May 1, 2011.
Doronina , Development of potent monoclonal antibody auristatin conjugates for cancer therapy, 2003, Nat Biotechnol 21(7):778-784.
Dreier, et al., Extremely Potent, Rapid and Costimulation-Independent Cytotoxic T-cell Response Against Lymphoma Cells Catalyzed by a Single-Chain Bispecific Antibody, Int. J. Cancer, 2002, vol. 100, pp. 690-697.
Dreier, et al., T Cell Costimulus-Independent and Very Efficacious Inhibition of Tumor Growth in Mice Bearing Subcutaneous or Leukemic Human B Cell Lymphoma Xenografts by a CD19-/CD3-Bispecific Single-Chain Antibody Construct, The Journal of Immunology, 2003, vol. 170, pp. 4397-4402.
Dubowchik et al., Receptor-mediated and enzyme-dependent targeting of cytotoxic anticancer drugs, 1999, Pharm. Therapeutics 83:67-123.
Ducry et al., Antibody-drug conjugates: linking cytotoxic payloads to monoclonal antibodies, 2010, Bioconjugate Chem. 21:5-13.
Dudgeon, et al., General strategy for the generation of human antibody variable domains with increased aggregation resistance, PNAS Early Edition, 2012, pp. 10879-10884, www.pnas.org/cgi/doi/10.1073/pnas.1202866109 & Supporting Information.

(56) References Cited

OTHER PUBLICATIONS

Duke, et al., Measurement of apoptosis and other forms of cell death, 2004, Curr protocols immunol. 3.17.1-3.17.16.
DukSin et al., Relationship of the structure and biological activity of the natural homologues of tunicamycin, 1982, J. Biol. Chem. 257:3105.
Duval, et al., A Bispecific Antibody Composed of a Nonneutralizing Antibody to the gp41 Immunodominant Region and an Anti-CD89 Antibody Directs Broad Human Immunodeficiency Virus Destruction by Neutrophils, Journal of Virology, 2008, pp. 4671-4674, doi:10.1128/JVI.02499-07.
Edge et al., Deglycosylation of glycoproteins by trifluoromethanesulfonic acid, 1981, Anal. Biochem. 118:131.
Elliott, et al., Antiparallel Conformation of Knob and Hole Aglycosylated Half-Antibody Homodimers Is Mediated by a CH2—CH3 Hydrophobic Interaction, Journal of Molecular Biology, 2014, vol. 426, Issue 9, pp. 1947-1957.
Feldmann et al., Novel Humanized and Highly Efficient Bispecific Antibodies Mediate Killing of Prostate Stem Cell Antigen-Expressing Tumor Cells by CD8+ and CD4+ T cells, Aug. 8, 2012.
Feldmann et al., Retargeting of T Cells to Prostate Stem Cell Antigen Expressing Tumor Cells: Comparison of Different Antibody Formats, Dec. 28, 2010.
Fernandes, et al., T Cell Receptors are Structures Capable of Initiating Signaling in the Absence of Large Conformational Rearrangements, The Journal of Biological Chemistry, 2012, vol. 287, No. 16, pp. 13324-13335.
Fischer, Nicolas et al., "Bispecifc antibodies: molecules that enable novel therapeutic strategies", 2007, vol. 74, pp. 3-14.
Foreman, et al., ErbB3 Inhibitory Surrobodies Inhibit Tumor Cell Proliferation In Vitro and In Vivo, Mol Cancer Ther, 2012, vol. 11(7), pp. 1411-1420.
Foreman, et al., PEGS poster, "ErbB3 Inhibitory Surrobodies Inhibit Tumor Cell Proliferation In Vitro and In Vivo," 2012.
Fraker et al., Crystal structure of peptide cyclo-(D-VAL-L-PRO-L-VAL-D-PRO)$_3$, 1978, Biochem. Biophys. Res. Common. 80(4):849-57.
Francois, et al., Construction of a Bispecific Antibody Reacting with the α-and β-Chains of the Human IL-2 Receptor, The Journal of Immunology, May 15, 1993, vol. 150, No. 10, pp. 4610-4619.
F-star Modular Antibodies Fact Sheet, Apr. 2008, "Modular Antibody Technology" (w/ reference to Ruker WO 2006/072620 A1).
F-star Modular Antibodies Press Release, Mar. 28, 2008, "Antibody Engineering Company F-Star Buys Back Royalty Obligations. TVM Capital Joins Investor Syndicate.".
Fudenberg, et al., Serologic Demonstration of Dual Specificity of Rabbit Bivalent Hybrid Antibody, The Journal of Experimental Medicine, 1964, vol. 119(1), pp. 151-166.
Ganesan, et al., FcγRIIb on Liver Sinusoidal Endothelium Clears Small Immune Complexes, The Journal of Immunology, Nov. 15, 2012, vol. 189 No. 10, pp. 4981-4988.
GenBank AAA38124.1, immunoglobulin heavy-chain VJ region [Mus musculus] Protein/NCBI.
GenBank AAA39180.1, immunoglobulin light-chain VJ region [Mus musculus] Protein/NCBI.
Ghendler et al., One of the CD3ε Subunits within a T Cell Receptor Complex Lies in Close Proximity to the Cβ FG Loop, J. Exp. Med., 1998, vol. 187, No. 9. pp. 1529-1536.
Ghetie et al., Multiple roles for the major histocompatibility complex Class I-related receptor FcRn, 2000, Annu Rev Immunol 18:739-766.
Gilliland, et al., Universal bispecific antibody for targeting tumor cells for destruction by cytotoxic T cells, Proc. Natl. Acad. Sei. USA, 1988, vol. 85, pp. 7719-7723.
Gorman et al., Reshaping a therapeutic CD4 antibody, Proc. Natl. Acad. Sci. USA 88:4181-4185.
Grodzki & Bernstein, "Antibody Purification: Ion-Exchange Chromatography.", Methods Mol Biol 2010 ;588:27-32.

Gunasekaran et al., Enhancing Antibody Fc Heterodimer Formation through Electrostatic Steering Effects, Journal of Biological Chemistry, vol. 285, No. 25, pp. 19637-10946, Apr. 16, 2010 & Supplementary Tables.
Haagen, et al., The Efficacy of CD3×CD19 Bispecific Monoclonal Antibody (BsAb) in a Clonogenic Assay: The Effect of Repeated Addition of BsAb, and Interleukin-2, Blood, 1995, vol. 85, No. 11, pp. 3208-3212.
Hakimuddin et al., A chemical method for the deglycosylation of proteins, 1987, Arch. Biochem. Biophys. 259:52.
Hamel, et al., The Role of the $V_L$- and $V_H$- Segments in the Preferential Reassociation of Immunoglobulin Subunits, Molecular Immunology, 1986, vol. 23, No. 5, pp. 503-510.
Hawkins et al., Selection of phage antibodies by binding affinity mimicking affinity maturation, 1992, J. Mol. Biol. 226:889-896.
Hayden-Ledbetter, et al., CD20-Directed Small Modular Immunopharmaceutical, TRU-015, Depletes Normal and Malignant B Cells, Clin Cancer Res, 2009, vol. 15(8), pp. 2739-2746.
He et al., Humanization and pharmacokinetics of a monoclonal antibody with specificity for both E- and P-selectin, 1998, J. Immunol. 160:1029-1035.
Hennecke et al., "Non-repetitive single-chain Fv linkers selected by selectively infective phage (SIP) technology.", Protein Eng. May 1998;11(5):405-10.
Hernandez-Caselles, et al., A study of CD33 (SIGLEC-3) antigen expression and function on activated human T and NK cells: two isoforms of CD33 are generated by alternative splicing, J. Leukoc. Biol., 2006, vol. 79, pp. 46-58.
Hexham, et al., Influence of relative binding affinity on efficacy in a panel of anti-CD3 scFv immunotoxins, Molecular Immunology, 2001, vol. 38, pp. 397-408.
Hinman et al., Preparation and characterization of monoclonal antibody conjugates of the calicheamicins: a novel and potent family of antitumor antibodies, 1993 Cancer Res. 53:3336-3342.
Hoffmann, et al., Serial killing of tumor cells by cytotoxic T cells redirected with a CD19-/CD3-bispecific single-chain antibody construct, Int. J. Cancer, 2005, vol. 115, pp. 98-104.
Holliger et al., "Diabodies": Small Bivalent and bispecific antibody fragments, 1993, Proc. Natl. Acad. Sci. U.S.A. 90:6444-6448.
Holliger et al., Engineering bispecific antibodies, 1993, Current Opinion Biotechnol. 4:446-449.
Houtenbos, et al., The novel bispecific diabody αCD40/αCD28 strengthens leukaemic dendritic cell-induced T-cell reactivity, British Journal of Haematology, 2008, vol. 142, pp. 273-283.
Hu et al., Minibody: A novel engineered anti-carcinoembryonic antigen antibody fragment (single-chain Fv-$C_H3$) which exhibits rapid, high-level targeting of xenografts, 1996, Cancer Res. 56:3055-3061.
Huston et al., Protein engineering antibody binding sites: recovery of specific activity in an anti-digoxin single-chain Fv analogue produced in *Escherichia coli*, 1988, Proc. Natl. Acad. Sci. U.S.A. 85:5879-5883.
Igawa et al., Reduced elimination of IgG antibodies by engineering the variable region, 2010, PEDS. 23(5): 385-392.
Igawa, $V_H/V_L$ interface engineering to promote selective expression and inhibit conformational isomerization of thrombopoietin receptor agonist single-chain diabody. Protein Engineering, Design & Selection, 2010, vol. 23, No. 8, pp. 667-677.
Ishigaki et al., Impact of Plasma Oxidized Low-Density Lipoprotein Removal on Atherosclerosis., Circulation 118: 75-83, 2008.
Jackson et al., In vitro antibody maturation, 1995, J. Immunol. 154(7):3310-9.
Jäger, et al., The Trifunctional Antibody Ertumaxomab Destroys Tumor Cells That Express Low Levels of Human Epidermal Growth Factor Receptor 2, Cancer Res, 2009, vol. 69(10), pp. 4270-4276.
Jefferis et al., Interaction sites on human IgG-Fc for FcγR: current models, 2002, Immunol Lett 82:57-65.
Jespers, et al., Crystal Structure of HEL4, a Soluble, Refoldable Human $V_H$ Single Domain with a Germ-line Scaffold, J. Mol. Biol., 2004, vol. 337, pp. 893-903.

(56) References Cited

OTHER PUBLICATIONS

Jimenez, et al., A recombinant, fully human, bispecific antibody neutralizes the biological activities mediated by both vascular endothelial growth factor receptors 2 and 3, Mol Cancer Ther, 2005, vol. 4(3), pp. 427-434.
Jin et al. The Design and Engineering of IgG-Like Bispecific Antibodies., Chapter 9, Bispecific Antibodies, pp. 151-169.
Jin, et al., MetMAb, the One-Armed 5D5 Anti-c-Met Antibody, Inhibits Orthotopic Pancreatic Tumor Growth and Improves Survival, Cancer Res 2008, vol. 68, pp. 4360-4368.
Johnson et al., Anti-tumor activity of CC49-doxorubicin immunoconguates, 1995, Anticancer Res. 15:1387-93.
Johnson, et al., Effector Cell Recruitment with Novel Fv-based Dual-affinity Re-targeting Protein Leads to Potent Tumor Cytolysis and in Vivo B-cell Depletion, J. Mol. Biol., 2010, vol. 399, pp. 436-449.
Jones et al., Replacing the complementarity-determining regions in a human antibody with those from a mouse, 1986, Nature 321:522-525.
Jordan et al., Structural understanding of stabilization patterns in engineered bispecific Ig-like antibody molecules, Proteins 2009; 77:832-841, Jun. 19, 2009.
Jung, et al., Design of interchain disulfide bonds in the framework region of the Fv fragment of the monoclonal antibody B3, Proteins, 1994, vol. 19(1), pp. 35-47.
Jung, et al., Target Cell-restricted Triggering of the CD95 (APO-1/Fas) Death Receptor with Bispecific Antibody Fragments, Cancer Research, 2001, vol. 61, pp. 1846-1848.
Jungbluth et al., A monoclonal antibody recognizing human cancers with amplification/overexpression of the human epidermal growth factor receptor, 2003, Proc Natl Acad Sci U S A. 100(2):639-44.
Kabat et al., 1991, Sequences of proteins of immunological interest, Department of Health and Human Services, Bethesda, vol. 1, $5^{th}$ Ed.
Kakutani et al., Accumulation of LOX-1 ligand in plasma and atherosclerotic lesions of Watanabe heritable hyperlipidemic rabbits: identification by a novel enzyme immunoassay.,Biochem Biophys Res Commun. Mar. 23, 2001;282(1):180-5.
Kanakaraj, et al., Simultaneous targeting of TNF and Ang2 with a novel bispecific antibody enhances efficacy in an in vivo model of arthritis, mAbs, 2012, vol. 4, Issue 5, pp. 600-613, http://dx.doi.org/10.4161/mabs.21227 & Supplemental Data.
Kettleborough et al., Humanization of a mouse monoclonal antibody by CDR-grafting: the importance of framework residues on loop conformation, 1991, Protein Eng. 4(7):773-83.
Keyna, et al., Surrogate Light Chain-Dependent Selection of Ig Heavy Chain V Regions, J. Immunol., 1995, vol. 155, pp. 5536-5542.
Kharmate et al., Inhibition of tumor promoting signals by activation of SSTR2 and opioid receptors in human breast cancer cells., Cancer Cell Int. Sep. 23, 2013;13(1):93. doi: 10.1186/1475-2867-13-93.
Kiewe, et al., Phase I Trial of the Trifunctional Anti-HER2×Anti-CD3 Antibody Ertumaxomab in Metastatic Breast Cancer, Clin Cancer Res., 2006, vol. 12(10), pp. 3085-3091.
Kim et al., "Localization of the site of murine IgG1 molecule that is involved in binding the murine intestinal Fc receptor," Eur. J. Immunol., 24:2429-2434, 1994.
Kim et al., Mutational approaches to improve the biophysical properties of human single-domain antibodies., Biochim Biophys Acta. Nov. 2014;1844(11):1983-2001. doi: 10.1016/j.bbapap.2014.07.008. Epub Jul. 24, 2014.
Kipriyanov, et al., Bispecific CD3×CD19 Diabody for T Cell-Mediated Lysis of Malignant Human B Cells, Int. J. Cancer, 1998. vol. 77, pp. 763-772.
Kipriyanov, et al., Bispecific Tandem Diabody for Tumor Therapy with Improved Antigen Binding and Pharmacokinetics, J. Mol. Biol., 1999, vol. 293, pp. 41-56.
Kipriyanov, et al., Effect of Domain Order on the Activity of Bacterially Produced Bispecific Single-chain Fv Antibodies, J. Mol. Biol., 2003, vol. 330, pp. 99-111.
Kipriyanov, et al., Two amino acid mutations in an anti-human CD3 single chain Fv antibody fragment that affect the yield on bacterial secretion but not the affinity, Protein Engineering, 1997, vol. 10, No. 4, pp. 445-453.
Klein et al., Progression of metastatic human prostate cancer to androgen independence in immunodeficient SDIC mice, 1997, Nature Medicine 3:402-408.
Klein, et al., Progress in overcoming the chain association issue in bispecific heterodimeric IgG antibodies, mAbs, Nov.-Dec. 2012, vol. 4, issue 6, pp. 653-663, doi: 10.4161/mabs.21379, Epub Aug. 27, 2012.
Klinger, et al., Immunopharmacologic response of patients with B-lineage acute lymphoblastic leukemia to continuous infusion of T cell-engaging CD19/CD3-bispecific BiTE antibody blinatumomab, Blood, 2012, vol. 119, No. 26, pp. 6226-6233.
Koristka, et al., Retargeting of Human Regulatory T Cells by Single-Chain Bispecific Antibodies, The Journal of Immunology, 2012, vol. 188, pp. 1551-1558, www.jimmunol.org/cgi/doi/10.4049/jimmunol.1101760.
Kostelny, et al., Formation of a Bispecific Antibody by the Use of Leucine Zippers, The Journal of Immunology 1992, vol. 148, pp. 1547-1553.
Krah et al., "Single-domain antibodies for biomedical applications.", Immunopharmacol Immunotoxicol. 2016;38(1):21-8. doi: 10.3109/08923973.2015.1102934. Epub Nov. 9, 2015.
Krauss et al., Specificity grafting of human antibody frameworks selected from a phage display library: generation of a highly stable humanized anti-CD22 single-chain Fv fragment, 2003, Protein Engineering 16(10):753-759.
Krupka, et al., CD33 target validation and sustained depletion of AML blasts in long-term cultures by the bispecific T-cell-engaging antibody AMG 330, Blood, 2014, vol. 123, No. 3, pp. 356-365, Prepublished online Dec. 3, 2013; doi:10.1182/blood-2013-08-523548 & Data Supplement.
Kung, et al., Monoclonal Antibodies Defining Distinctive Human T Cell Surface Antigens, Science, 1979, vol. 206, pp. 347-349.
Kuppen, peter et al., The development and purification of a bispecific antibody for lymphokine-activated killer cell targeting against the rat colon carcinoma CC531., Cancer Immunol Immunother. Jun. 1993;36(6):403-8.
Labrijn, et al., Efficient generation of stable bispecific IgG1 by controlled Fab-arm exchange, www.pnas.org/cgi/doi/10.1073/pnas.1220145110 & Supporting Information.
Laszlo et al., Cellular determinants for preclinical activity of a novel CD33/CD3 bispecific T-cell engager (BiTE) antibody, AMG 330, against human AML, blood 2014 123: 554-561, Dec. 5, 2013.
Lau et al., Conjugation of Doxorubicin to monoclonal anti-carcinoembryonic antigen antibody via novel thiol-directed cross-linking regents, 1995, Bioorg-Med-Chem. 3(10):1299-1304.
Lau et al., Novel doxorubicin-monoclonal anti-carcinoembryonic antigen antibody immunoconjugate activity in vitro, 1995, Bioorg-Med-Chem. 3(10):1305-12.
Lazar Declaration, Dec. 27, 2010, pp. 1-4.
Lewis, et al., Generation of bispecific IgG antibodies by structure-based design of an orthogonal Fab interface, Nature Biotechnology, 2014, doi:10.1038/nbt.2797 & Supplemental Information.
Li, et al., Construction and characterization of a humanized anti-human CD3 monoclonal antibody 12F6 with effective immunoregulation functions, Immunology, 2005, vol. 116, pp. 487-498.
Lindhofer, et al., Preferential Species-Restricted Heavy/Light Chain Pairing in Rat/Mouse Quadromas: Implications for a Single-Step Purification of Bispecific Antibodies, The Journal of Immunology, 1995, vol. 155, pp. 219-225.
Ling, et al., Interspecies Scaling of Therapeutic Monoclonal Antibodies: Initial Look, J Clin Pharmacol, 2009, vol. 49, pp. 1382-1402, doi: 10.1177/0091270009337134.
Link, et al., Production and Characterization of a Bispecific IgG Capable of Inducing T-Cell-Mediated Lysis of Malignant B Cells, Blood, 1993, vol. 81, No. 12, pp. 3343-3349.
Linke, et al., Catumaxomab, Clinical development and future directions, mAbs, 2010, vol. 2, Issue 2, pp. 129-136.
Little, et al., Letter to the Editor, "Flawed TandAb production," Molecular Immunology, 2007, vol. 44, p. 3083.

(56) References Cited

OTHER PUBLICATIONS

Liu et al, Asymmetrical Fc Engineering Greatly Enhances Antibody-dependent Cellular Cytotoxicity (ADCC) Effector Function and Stability of the Modified Antibodies, J. Biol. Chem. 2014, 289: 3571-3590, Dec. 5, 2013.

Liu et al., Eradication of large colon tumor xenografts by targeted delivery of maytansinoids, 1996 Proc. Natl. Acad. Sci. USA 93:8618-8623.

Liu, et al., Crystallization of a Deglycosylated T Cell Receptor (TCR) Complexed with an Anti-TCR Fab Fragment, The Journal of Biological Chemistry, 1996, vol. 271, No. 52, pp. 33639-33646.

Lode et al., Targeted therapy with a novel enediyne antibiotic calicheamicins $o^I{}_1$ effectively suppress growth and dissemination of liver metastases in a syngeneic model of murine neuroblastoma, 1998, Cancer Res. 58:2928.

Löffler, et al., A recombinant bispecific single-chain antibody, CD19×CD3, induces rapid, and high lymphoma-directed cytotoxicity by unstimulated T lymphocytes, Blood, 2000, vol. 95, No. 6, pp. 2098-2103.

Lu, et al., A Fully Human Recombinant IgG-like Bispecific Antibody to Both the Epidermal Growth Factor Receptor and the Insulin-like Growth Factor Receptor for Enhanced Antitumor Activity, The Journal of Biological Chemistry, 2005, vol. 280, No. 20, pp. 19665-19672.

Lu, et al., Di-diabody: a novel tetravalent bispecific antibody molecule by design, Journal of Immunological Methods, 2003, vol. 279, pp. 219-232.

Lu, et al., Fab-scFv fusion protein: an efficient approach to production of bispecific antibody fragments, Journal of Immunological Methods, 2002, vol. 267, pp. 213-226.

Lu, et al., The effect of variable domain orientation and arrangement on the antigen-binding activity of a recombinant human bispecific diabody, Biochemical and Biophysical Research Communications, 2004, vol. 318, pp. 507-513.

Lum, et al., The new face of bispecific antibodies: targeting cancer and much more, Experimental Hematology, 2006, vol. 34, pp. 1-6.

Lutterbuese, et al., AACR Poster, "Conversion of Cetuximab, Panitumumab, Trastuzumab and Omalizumab into T Cell-engaging BiTE Antibodies Creates Novel Drug Candidates of High Potency," 2008.

Lutterbuese, et al., T cell-engaging BiTE antibodies specific for EGFR potently eliminate KRAS- and BRAF-mutated colorectal cancer cells, PNAS Early Edition, 2010, www.pnas.org/cgi/doi/10.1073/pnas.1000976107 & Supporting Information.

Ma, et al., Expression and Characterization of a Divalent Chimeric Anti-Human CD3 Single Chain Antibody, Scand.J.Immunol, 1996, vol. 43, pp. 134-139.

Mabry, et al., A dual-targeting PDGFRβ/NVEGF-A molecule assembled from stable antibody fragments demonstrates anti-angiogenic activity in vitro and in vivo, mAbs, 2010, vol. 2, Issue 1, pp. 20-34; www.landesbioscience.com/Journals/mabs/article/10498 & Supplemental Information.

Mabry, et al., Engineering of stable bispecific antibodies targeting IL-17A and IL-23, Protein Engineering, Design & Selection, 2009, vol. 23, No. 3, pp. 115-127; doi:10.1093/protein/gzp073 & Supplementary Figures 1-8.

Mack, et al., A small bispecific antibody construct expressed as a functional single-chain molecule with high tumor cell cytotoxicity, Proc. Natl. Acad. Sci. USA, 1995, vol. 92, pp. 7021-7025.

Mack, et al., Biologic Properties of a Bispecific Single-Chain Antibody Directed Against 17-1A (EpCAM) and CD3—Tumor Cell-Dependent T Cell Stimulation and Cytotoxic Activity, The Journal of Immunology, 1997, vol. 158, pp. 3965-3970.

MacroGenics Factsheet, Dual Affinity Re-Targeting ("DART") Platform, 2010.

Mandler et al., Immunoconjugates of geldanamycin and anti-HER2 Monoclonal antibodies: antiproliferative activity on human breast carcinoma cell lines, 2000, J. Nat. Cancer Inst. 92(19):1573-1581.

Mandler et al., Modifications in synthesis strategy improve the yield and efficacy of geldanamycin-herceptin immunoconjugates, 2002, Bioconjugate Chem. 13:786-791).

Mandler et al., Synthesis and evaluation of antiproliferative activity of a geldanaymcin-herceptin™ immunoconjugates, 2000, Bioorganic & Med. Chem. Letters 10:1025-1028.

Mandy, et al., Effect of Reduction of Several Disulfide Bonds on the Properties and Recombination of Univalent Fragments of Rabbit Antibody, The Journal of Biological Chemistry, 1963, vol. 238, No. 1, pp. 206-213.

Mandy, et al., Recombination of Univalent Subunits Derived from Rabbit Antibody, The Journal of Biological Chemistry, 1961, vol. 236, No. 12, pp. 3221-3226.

Marks et al., By-passing immunization: building high affinity human antibodies by chain shuffling, 1992, Biotechnology 10:779-783.

Martin, et al., Generation of the Germline Peripheral B Cell Repertoire: VH81X-λ B Cells Are Unable to Complete All Developmental Programs, J. Immunol., 1998, vol. 160, pp. 3748-3758.

Martinez, et al., Characterization of a novel modification on IgG2 light chain: Evidence for the presence of O-linked mannosylation, J. Chromatogr. A, 2007, vol. 1156 pp. 183-187.

Marvin, Bispecifio antibodies for dual-modality cancer therapy: killing two signaling cascades with one stone, Curr Opin Drug Discov Devel, 2006, vol. 9(2), pp. 184-193.

Marvin, et al., Recombinant approaches to IgG-like bispecific antibodies, Acta Pharmacologica Sinica, 2005, vol. 26 (6), pp. 649-658.

Mateo et al, Humanization of a mouse nonoclonal antibody that blocks the epidermal growth factor receptor: recovery of antagonistic activity, 1997, Immunotechnology, 3(1):71-81.

McPhee, Engineering human immunodeficiency virus 1 protease heterodimers as macromolecular inhibitors of viral maturation, Proc. Natl. Acad. Sci. USA, 1996, vol. 93, pp. 11477-11481.

Meijer, et al., Isolation of Human Antibody Repertoires with Preservation of the Natural Heavy and Light Chain Pairing, J. Mol. Biol., 2006, vol. 358, pp. 764-772.

Merchant, et al., An efficient route to human bispecific IgG, Nature Biotechnology, 1998, vol. 16, pp. 677-681.

Mertens, Nico, "Tribodies: Fab-scFv fusion proteins as a platform to create multi-functional pharmaceuticals.", SpringerLink 2011, 135-149.

Metz, et al., Bispecific antibody derivatives with restricted binding functionalities that are activated by proteolytic processing, Protein Engineering, Design & Selection, 2012, vol. 25, No. 10, pp. 571-580.

Metz, et al., Bispecific digoxigenin-binding antibodies for targeted payload delivery, PNAS, 2011, vol. 108, No. 20, pp. 8194-8199.

Michaelson et al., Anti-tumor activity of stability-engineered IgG-like bispecific antibodies targeting TRAIL-R2 and LTbetaR, [mAbs 1:2, 128-141; Mar./Apr. 2009]; Mar. 11, 2009.

Michalk et al., Characterization of a novel single-chain bispecific antibody for retargeting of T cells to tumor cells via the TCR co-receptor CD8., PLoS One. Apr. 21, 2014;9(4):e95517. doi: 10.1371/journal.pone.0095517.

Miller et al., Stability engineering of scFvs for the development of bispecific and multivalent antibodies, PEDS, 2010, vol. 23, No. 7, pp. 549-557 & Supplementary Data.

Miller, biogen idec Stability Engineering and Production of IgG-like Bispecifc Antibodies, AAPS National Biotechnology Conference, Jun. 24 to Jun. 27, 2007.

Milutinovic, et al., Sanford Burnham Medical Research Institute / AACR Poster, #4318, "Development of a novel dual agonist Surrobody™ that simultaneously activates both death receptors DR4 and DR5 and induces cancer cell death with high potency".

Mimoto et al., Engineered antibody Fc variant with selectively enhanced FcγRIIb binding over both FcγRIIa(R131) and FcγRIIa(H131)., Protein Eng Des Sel. Oct. 2013;26(10):589-98. doi: 10.1093/protein/gzt022. Epub Jun. 5, 2013.

Mimoto, et al., Novel asymmetrically engineered antibody Fc variant with superior FcγR binding affinity and specificity compared with afucosylated Fc variant, mAbs, 2013, vol. 5, Issue 2, pp. 229-236.

(56) References Cited

OTHER PUBLICATIONS

Modjtahedi et al, Phase I trial and tumour localization of the anti-EGFR monoclonal antibody ICR62 in head and neck or lung cancer, 1996, Br J Cancer, 73(2):228-35.

Modjtahedi et al., Targeting of cells expressing wild-type EGFR and type-III mutant EGFR (EGFRVIII) by anti-EGFR MaB ICR62: a two-pronged attack for tumor therapy, 2003, Int J Cancer, 105(2):273-80.

Modjtahedi et al., Antitumor activity of combinations of antibodies directed against different epitopes on the extracellular domain of the human EGF receptor, 1993, J. Cell Biophys. 1993, 22(1-3):129-46.

Modjtahedi et al., The human EGF receptor as a target for cancer therapy: six new rat mAbs against the receptor on the breast carcinoma MDA-MB 468, 1993, Br J Cancer. 1993, 67(2):247-53.

Mølhøj, et al., CD19-/CD3-bispecific antibody of the BiTE class is far superior to tandem diabody with respect to redirected tumor cell lysis, Molecular Immunology 2007, vol. 44, pp. 1935-1943.

Moore et al., Tuning T Cell Affinity Improves Efficacy and Safety of Anti-CD38×Anti-CD3 Bispecific Antibodies in Monkeys—a Potential Therapy for Multiple Myeloma., 57th ASH Annual Meeting and Exposition (Dec. 5-8, 2015), American Society of Hematology, Orlando, Florida.

Moore, et al., A novel bispecific antibody format enables simultaneous bivalent and monovalent co-engagement of distinct target antigens., MAbs. Nov.-Dec. 2011; 3(6): 546-557; Published online Nov. 1, 2011. doi: 10.4161/mabs.3.6.18123.

Moore, et al., Application of dual affinity retargeting molecules to achieve optimal redirected T-cell killing of B-cell lymphoma, Blood, 2011, vol. 117, No. 17, pp. 4542-4551.

Moretti et al., BEAT® the bispecific challenge: a novel and efficient platform for the expression of bispecific IgGs. BMC Proceedings 2013 7(Suppl 6):O9.

Morrison, et al., News and Views: Two heads are better than one, Nature Biotechnology, 2007, vol. 25, No. 11, pp. 1233-1234.

Mosmann, 1983, Rapid colorimetric assay for cellular growth and survival: application to proliferation and cytotoxicity assays, J. Immunol. Methods 65:55-63.

Muda, et al., Therapeutic assessment of SEED: a new engineered antibody platform designed to generate mono and bispecific antibodies, Protein Engineering, Design & Selection, 2011, vol. 24, No. 5, pp. 447-454.

Muramatsu et al., Production and characterization of an active single-chain variable fragment antibody recognizing CD25., Cancer Lett. Jul. 28, 2005;225(2):225-36. Epub Jan. 23, 2005.

Murthy et al., Binding of an antagonistic monoclonal antibody to an intact and fragmented EGF-receptor polypeptide, 1987, Arch Biochem Biophys. 252(2):549-60.

Nagorsen, et al., Blinatumomab: A historical perspective, Pharmacology & Therapeutics, 2012, vol. 136, pp. 334-342, http://dx.doi.org/10.1016/j.pharmthera.2012.07.013.

Nelson, et al., Point of View: Antibody fragments—Hope and hype, mAbs, 2010, vol. 2, Issue 1, pp. 77-83.

Neville et al., Enhancement of immunotoxin efficacy by acid-cleavable cross-ling agents utilizing diphtheria toxin and toxin mutants, 1989, Biol. Chem. 264:14653-14661.

Nielsen, et al., Human T cells resistant to complement lysis by bivalent antibody can be efficiently lysed by dimers of monovalent antibody, Blood, 2002, vol. 100, No. 12, pp. 4067-4073.

Nisonoff, et al., Letters to the Editors: Recombination of a Mixture of Univalent Antibody Fragments of Different Specificity, Arch. Biochem. Biophys., 1961, pp. 460-462.

Nisonoff, et al., Quantitative Estimation of the Hybridization of Rabbit Antibodies, Nature, 1962, vol. 194, No. 4826, pp. 355-359.

North, et al., A New Clustering of Antibody CDR Loop Conformations, J. Mol. Biol., 2011, vol. 406, pp. 228-256, doi:10.1016/j.jmb.2010.10.030.

O'Connor et al., Humanization of an antibody against human protein C and calcium-dependence involving framework residues, 1998, Protein Eng 11:321-8.

Olafsen, et al., Covalent disulfide-linked anti-CEA diabody allows site-specific conjugation and radiolabeling for tumor targeting applications, Protein Engineering, Design & Selection, 2004, vol. 17, No. 1, pp. 21-27.

Page et al., 1993, Intermantional. Journal of Oncology 3:473-476.

Panke, et al., Quantification of cell surface proteins with bispecific antibodies, Protein Engineering, Design & Selection, 2013, vol. 26, No. 10, pp. 645-654.

Pessano, et al., The T3/T cell receptor complex: antigenic distinction between the two 20-kd T3 (T3-6 and T3-ε) subunits, The EMBO Journal, 1985, vol. 4, No. 2, pp. 337-344.

Pettit et al., Antineoplastic agents 365. Dolastatin 10 SAR probes, 1998, Anti-Cancer Drug Design 13:243-277.

Pettit et al., Dolastatins 24. Synthesis of (−)-dolastatin 10.I X-ray molecular structure of N,N-dimethylvalyl-valyl-dolaisoleuine tert-butyl ester, 1996, J. Chem. Soc. Perkin Trans. 1 5:859-863.

Pettit et al., Specific activities of dolastatin 10 and peptide derivatives against Cryptococcus neoformans, 1998, Antimicrob. Agents Chemother. 42(11):2961-2965.

Pettit et al., Structure-activity studies with chiral isomers and with segments of the antimitotic marine peptide dolastation 10, 1989, J. Am. Chem. Soc. 111:5463-5465.

Pettit, et al., The dolastatins; 18: Sterospecific synthesis of dolaproine1, 1996, Synthesis 719-725.

Pichler et al., Differences of T-Cell Activation by the Anti-CD3 Antibodies Leu4 and BMA030, Mar. 30, 1987.

Potapov et al., Protein-Protein Recognition: Juxtaposition of Domain and Interface Cores in Immunoglobulins and Other Sandwich-like Proteins, J. Mol. Biol., 2004, vol. 342, pp. 665-679.

Presta et al., Humanization of an anti-vascular endothelial growth factor monoclonal antibody for the therapy of solid tumors and other disorders, 1997, Cancer Res.57(20):4593-9.

Queen et al., A humanized antibody that binds to the interleukin 2 receptor, 1989, Proc Natl Acad Sci, USA 86:10029-33.

Rader et al., A phage display approach for rapid antibody humanization: designed combinatorial V gene libraries, 1998, Proc. Natl. Acad. Sci. USA 95: 8910-8915.

Raghavan et al., Fc receptors and their interactios with immunoglobulins, 1996, Annu Rev Cell Dev Biol 12:181-220.

Rattel, et al., AACR Poster, "Validation of Cynomolgus Monkeys as Relevant Species for Safety Assessment of a Novel Human BiTE Antibody Platform for Cancer Therapy," 2010.

Reddy et al., Elimination of Fc receptor-dependent effector functions of a modified IgG4 monoclonal antibody to human CD4., J Immunol. Feb. 15, 2000;164(4):1925-33.

Reiter et al., Disulfide stabilization of antibody Fv: computer predictions and experimental evaluation, Protein Eng., 1995, vol. 8(12), pp. 1323-1331.

Reiter et al., Engineering interchain disulfide bonds into conserved framework regions of Fv fragments: improved biochemical characteristics of recombinant immunotoxins containing disulfide-stabilized Fv, Protein Eng., 1994, vol. 7(5), pp. 697-704.

Remington's Pharmaceutical Sciences 16th edition, Osol, A. Ed. (1980) (Book Abstract).

Repp, et al., Combined Fc-protein- and Fc-glyco-engineering of scFv-Fc fusion proteins synergistically enhances CD16a binding but does not further enhance NK-cell mediated ADCC, Journal of Immunological Methods, 2011, vol. 373, Issues 1-2, pp. 67-78.

Ridgway, et al., 'Knobs-into-holes' engineering of antibody CH3 domains for heavy chain heterodimerization, Protein Engineering,1996, vol. 9, No. 7, pp. 617-621.

Riechmann et al., Reshaping human antibodies for therapy, 1988, Nature 332:323-329.

Riethmüller, Symmetry breaking: bispecific antibodies, the beginnings, and 50 years on, Cancer Immunity, 2012, vol. 12, p. 12, pp. 1-7.

Rodeck et al., Interactions between growth factor receptors and corresponding monoclonal antibodies in human tumors, 1987, J Cell Biochem. 35(4):315-20.

Roguska et al., Humanization of murine monoclonal antibodies through variable domain resurfacing, 1994, Proc. Natl. Acad. Sci. USA 91:969-973.

(56) References Cited

OTHER PUBLICATIONS

Roosnek, et al., Triggering T Cells by Otherwise Inert Hybrid Anti-CD3/Antitumor Antibodies Requires Encounter with the Specific Target Cell, J. Exp. Med., 1989, vol. 170, pp. 297-302.

Roque et al., Antibodies and genetically engineered related molecules: production and purification, 2004, Biotechnol. Prog. 20:639-654.

Rose, et al., Mutation of Y407 in the CH3 domain dramatically alters glycosylation and structure of human IgG, mAbs, 2013, vol. 5, Issue 2, pp. 219-228.

Rose, et al., Quantitative Analysis of the Interaction Strength and Dynamics of Human IgG4 Half Molecules by Native Mass Spectrometry, Structure, 2011, vol. 19, pp. 1274-1282.

Rosok et al., A combinatorial library strategy for the rapid humanization of anticarcinoma BR 96 Fab, 1996, J. Biol. Chem. 271(37): 22611-22618.

Rossi, et al., A new class of bispecific antibodies to redirect T cells for cancer immunotherapy, mAbs 2014, vol. 6, Issue 2, pp. 381-391.

Roux, et al., Structural analysis of the nurse shark (new) antigen receptor (NAR): Molecular convergence of NAR and unusual mammalian immunoglobulins, Proc. Natl. Acad. Sci. USA, 1998, vol. 95, pp. 11804-11809.

Rudnick, et al., Affinity and Avidity in Antibody-Based Tumor Targeting, Cancer Biotherapy and Radiopharmaceuticals, 2009, vol. 24, No. 2, pp. 155-161, doi: 10.1089/cbr.2009.0627.

Röthlisberger, et al., Domain Interactions in the Fab Fragment: A Comparative Evaluation of the Single-chain Fv and Fab Format Engineered with Variable Domains of Different Stability, J. Mol. Biol., 2005, vol. 347, pp. 773-789.

Salmeron et al., A conformational epitope expressed upon association of CD3-epsilon with either CD3-delta or CD3-gamma is the main target for recognition by anti-CD3 monoclonal antibodies, Nov. 1, 1991.

Sancho et al., CD3– Surface Expression Is Required for CD4-p56ick-mediated Up-regulation of T Cell Antigen Receptor-CD3 Signaling in T Cells, Apr. 16, 1992.

Schaefer, et al., A Two-in-One Antibody against HER3 and EGFR Has Superior Inhibitory Activity Compared with Monospecific Antibodies, Cancer Cell, 2011, vol. 20, pp. 472-486 & Supplemental Information, pp. 1-21.

Schaefer, et al., Immunoglobulin domain crossover as a generic approach for the production of bispecific IgG antibodies, PNAS, 2011, vol. 108, No. 27, pp. 11187-11192.

Schlapschy, et al., Functional humanization of an anti-CD16 Fab fragment: obstacles of switching from murine λ to human λ or κ light chains, Protein Engineering, Design & Selection, 2009, vol. 22, No. 3, pp. 175-188, doi:10.1093/protein/gzn066.

Schlereth, et al., Eradication of Tumors from a Human Colon Cancer Cell Line and from Ovarian Cancer Metastases in Immunodeficient Mice by a Single-Chain Ep-CAM-/CD3-Bispecific Antibody Construct, Cancer Res 2005, vol. 65(7), pp. 2882-2889.

Schlereth, et al., T-cell activation and B-cell depletion in chimpanzees treated with a bispecific anti-CD19/anti-CD3 single-chain antibody construct, Cancer Immunol Immunother, 2006, vol. 55, pp. 503-514, doi:10.1007/s00262-005-0001-1.

Schoonjans, et al., Fab Chains As an Efficient Heterodimerization Scaffold for the Production of Recombinant Bispecific and Trispecific Antibody Derivatives, The Journal of Immunology, 2000, vol. 165, pp. 7050-7057.

Schroder et al., The Peptides, vol. pp 76-136, 1965, Academic Press.

Senter et al., Proceedings of the American Association for Cancer Research, 2004, vol. 45, Abstract No. 623.

Senter, Potent antibody drug conjugates for cancer therapy, 2009, Current Opin. Chem. Biol. 13:235.

Sforzini et al., Targeting of saporin to Hodgkin's lymphoma cells by anti-CD30 and anti-CD25 bispecific antibodies., Br J Haematol. Sep. 1998;102(4):1061-8.

Shalaby, et al., Development of Humanized Bispecific Antibodies Reactive with Cytotoxic Lymphocytes and Tumor Cells Overexpressing the HER2 Protooncogene, J.Exp.Med., 1992, vol. 175, pp. 217-225.

Shan, et al., Characterization of scFv-Ig Constructs Generated from the Anti-CD20 mAb 1F5 Using Linker Peptides of Varying Lengths, J Immunol, 1999, vol. 162, pp. 6589-6595.

Shearman, et al., Construction, Expression and Characterization of Humanized Antibodies Directed Against the Human α/β T Cell Receptor, The Journal of Immunology, 1991, vol. 147, No. 12, pp. 4366-4373.

Shen, et al., Catumaxomab, a rat/murine hybrid trifunctional bispecific monoclonal antibody for the treatment of cancer, Curr Opin Mol Ther, 2008, vol. 10(3), pp. 273-284.

Shen, et al., Single Variable Domain-IgG Fusion: A Novel Recombinant Approach to Fc Domain-Containing Bispecific Antibodies, The Journal of Biological Chemistry, 2006, vol. 281, No. 16, pp. 10706-10714.

Shields et al., Lack of fucose on human IgG1 N-linked oligosaccharide improves binding to human FcγRIII and antibody-dependent cellular toxicity, 2002, J Biol Chem 277:26733-26740.

Shier et al., Identification of functional and structural amino-acid residues by parsimonious mutagenesis, 1995, Gene 169:147-155.

Shinkawa et al., The absence of fucose but not the presence of galactose or bisecting N-acetylglucosamine of human IgG1 complex-type oligosaccharides shows the critical role of enhancing antibody-dependent cellular cytotoxicity, 2003, J Biol Chem 278:3466-3473.

Skehan et al., Identification of functional and structural amino-acid residues by parsimonious mutagenesis, 1990, J. Natl. Cancer Inst. 82(13):1107-12.

Smith et al., Mouse model recapitulating human Fcγ receptor structural and functional diversity., Proc Natl Acad Sci USA. Apr. 17, 2012;109(16):6181-6. doi: 10.1073/pnas.1203954109. Epub Apr. 2, 2012.

Soumyarani et al, Oxidatively modified high density lipoprotein promotes inflammatory response in human monocytes-macrophages by enhanced production of ROS, TNF-α, MMP-9, and MMP-2., Mol Cell Biochem. Jul. 2012;366(1-2):277-85. doi: 10.1007/s11010-012-1306-y. Epub Apr. 17, 2012.

Spies et al., Alternative molecular formats and therapeutic applications for bispecific antibodies., Mol Immunol. Jan. 27, 2015. pii: S0161-5890(15)00005-X. doi: 10.1016/j.molimm.2015.01.003.

Spiess, et al., Bispecific antibodies with natural architecture produced by co-culture of bacteria expressing two distinct half-antibodies, Nature Biotechnology, 2013, doi:10.1038/nbt.2621 & Supplemental Information.

Stamova, Unexpected recombinations in single chain bispecific anti-CD3-anti-CD33 antibodies can be avoided by a novel linker module, Oct. 29, 2011.

Stanfield, et al., Maturation of Shark Single-domain (IgNAR) Antibodies: Evidence for Induced-fit Binding, J. Mol. Biol., 2007, vol. 367, pp. 358-372.

Stewart, et al., Recombinant CD36 inhibits oxLDL-induced ICAM-1-dependent monocyte adhesion., Mol Immunol. Feb. 2006;43(3):255-67.

Strop, P. et al., Generating Bispecific Human IgG1 and IgG2 Antibodies from Any Antibody Pair, J. Mol. Biol., 2012, doi:10.1016/j.jmb.2012.04.020.

Szymkowski et al., Creating the next generation of protein therapeutics through rational drug design, Current opinion in drug discovery & development, Sep. 1, 2005, p. 590, XP055354917, England.

Tabriz et al., Biodistribution mechanisms of therapeutic monoclonal antibodies in health and disease., AAPS J. Mar. 2010;12(1):33-43. doi: 10.1208/S12248-009-9157-5. Epub Nov. 19, 2009.

Tan et al., "Superhumanized" antibodies: reduction of immunogenic potential by complementarity-determining region grafting with human germline sequences: application to an anti-CD28, 2002, J. Immunol. 169:1119-1125.

Tan, Philip, Presentation at PepTalk, Jan. 25, 2013, "Bi-specific ADAPTIR Molecule Targeting CD86 and Delivering Monomeric IL10 to Inhibit Antigen Presenting Cells".

(56) References Cited

OTHER PUBLICATIONS

Tang et al., Selection of linkers for a catalytic single-chain antibody using phage display technology., Journal of Biological Chemistry, American Society for Biochemistry and Molecular Biology, US, vol. 271, No. 26, Jan. 1, 1996, pp. 15682-9258.

Tarcsa et al., Chapter 10 Dual-Variable Domain Immunoglobulin (DVD-Ig™) Technology: A Versatile, Novel Format for the Next Generation of Dual-Targeting Biologics, Bispecific Antibodies 2011, pp. 171-185, 2011.

Teachey, et al., Cytokine release syndrome after blinatumomab treatment related to abnormal macrophage activation and ameliorated with cytokine-directed therapy, Blood, 2013, vol. 121, No. 26, pp. 5154-5157.

Tedgui, et al., Cytokines in atherosclerosis: pathogenic and regulatory pathways., Physiol Rev. Apr. 2006;86(2):515-81.

Terry M., "FDA Places Clinical Hold on AML Drug Co-Developed by Johnson & Johnson (JNJ) and Genmab A/S (Gen Co.)", Biospace 2016, Retrieved from the internet: https://www.biospace.com/article/fda-places-clinical-hold-on-aml-drug-co-developed-by-johnson-and-johnson-and-genmab-a-s-/.

Thompson, et al., An Anti-CD3 Single-chain Immunotoxin with a Truncated Diphtheria Toxin Avoids Inhibition by Pre-existing Antibodies in Human Blood, J.Biol.Chem., 1995, vol. 270, No. 47, pp. 28037-28041.

Thompson, et al., Improved binding of a bivalent single-chain immunotoxin results in increased efficacy for in vivo T-cell depletion, Protein Engineering, 2001, vol. 14, No. 12, pp. 1035-1041.

Thorne, et al., CD36 is a receptor for oxidized high density lipoprotein: implications for the development of atherosclerosis., FEBS Lett. Mar. 20, 2007;581(6):1227-32. Epub Feb. 28, 2007.

Thorpe et al., New coupling agents for the synthesis of immunotoxins containing a hindered disulfide bond with improved stability in Vivo, 1987, Cancer Res. 47:5924-5931.

Thotakura et al., Enzymatic deglycosylating of glycoproteins, 1987, Meth. Enzymol. 138:350.

Thurman et al., Detection of complement activation using monoclonal antibodies against C3d., J Clin Invest. May 2013;123(5):2218-30. doi: 10.1172/JCI65861. Epub Apr. 24, 2013.

Tomlinson et. al., Methods for generating multivalent and bispecific antibody fragments, 2000, Methods Enzymol. 326:461-479.

Topp, et al., Targeted Therapy With the T-Cell-Engaging Antibody Blinatumomab of Chemotherapy-Refractory Minimal Residual Disease in B-Lineage Acute Lymphoblastic Leukemia Patients Results in High Response Rate and Prolonged Leukemia-Free Survival, J Clin Oncol vol. 29, No. 18, pp. 2493-2498.

Traunecker et al., Bispecific single chain molecules (Janusins) target cytotoxic lymphocytes on HIV infected cells, The EMBO Journal, 1991, vol. 1, No. 12, pp. 3655-3659.

Tsurushita et al., Humanization of monoclonal antibodies, 2004, Molecular Biology of B Cells 533-545.

Umaña et al., Engineered glycoforms of an antineuro-blastoma IgG1 with optimized antibody-dependent cellular cytotoxic activity, 1999, Nat Biotechnol 17:176-180.

Valliere-Douglass, et al., O-Fucosylation of an antibody light chain: Characterization of a modification occurring on an IgG1 molecule, Glycobiology, 2009, vol. 19, No. 2, pp. 144-152, doi:10.1093/glycob/cwn116.

Van Boxel, et al., Some lessons from the systematic production and structural analysis of soluble αβ T-cell receptors, Journal of Immunological Methods, 2009, vol. 350, pp. 14-21.

Van Wauwe, et al., OKT3: A Monoclonal Anti-Human T Lymphoctye Antibody with Potent Mitogenic Properties, The Journal of Immunology, 1980, vol. 124, No. 6, pp. 2708-2713.

Verdier, et al., Determination of lymphocyte subsets and cytokine levels in Cynomolgus monkeys, Toxicology, 1995, vol. 105, pp. 81-90.

Verhoeyen et al., Reshaping human antibodies: grafting an antilysozyme activity, 1988, Science, 239:1534-1536.

Veri, et al., Therapeutic Control of B Cell Activation via Recruitment of Fcγ Receptor IIb (CD32B) Inhibitory Function With a Novel Bispecific Antibody Scaffold, Arthritis & Rheumatism, 2010, vol. 62, No. 7, pp. 1933-1943.

Vettermann, et al., Powered by pairing: The surrogate light chain amplifies immunoglobulin heavy chain signaling and pre-selects the antibody repertoire, Seminars in Immunology 18, 2006, pp. 44-55.

Von Kreudenstein, et al., Improving biophysical properties of a bispecific antibody scaffold to aid developability: Quality by molecular design, mAbs, 2013, vol. 5, Issue 5, pp. 1-9, http://dx.doi.org/10.4161/mabs.25632 & Supplemental Material.

Wang et al., Conserved amino acid networks involved in antibody variable domain interactions, Proteins, 2009, vol. 76, pp. 99-114.

Wang et al., Expression and characterization of recombinant soluble monkey CD3 molecules: mapping the FN18 polymorphic epitope, Molecular Immunology, 2004, vol. 40, pp. 1179-1188.

Wang, et al., A block in both early T lymphocyte and natural killer cell development in transgenic mice with high-copy numbers of the human CD3E gene, Proc. Natl. Acad. Sci. USA, 1994, vol. 91, pp. 9402-9406.

Ward, et al., Protein Engineering of Homodimeric Tyrosyl-tRNA Synthetase to Produce Active Heterodimers, The Journal of Biological Chemistry, 1986, vol. 261, No. 21, pp. 9576-9578.

Wawrzynczak et al., Methods for preparing immunotoxins: Effect of the linkage on activity and stability. In Immunoconjugates. Antibody Conjugates in Radio imaging and Therapy of Cancer. (C.-W. Vogel, editor). New York, Oxford University Press, pp. 28-55.

Weatherill, et al., Towards a universal disulphide stabilised single chain Fv format: importance of interchain disulphide bond location and vL-vH orientation, Protein Engineering, Design & Selection, 2012, vol. 25, No. 7. pp. 321-329.

Weiner, et al., The Role of T Cell Activation Bispecific Antibody Therapy in Anti-CD3 X Antitumor, Journal of Immunology, 1994, vol. 152, pp. 2385-2392.

Wesolowski, et al., Single domain antibodies: promising experimental and therapeutic tools in infection and immunity, Med Microbiol Immunol, 2009, vol. 198, pp. 157-174.

Whitlow, et al., An improved linker for single-chain Fv with reduced aggregation and enhanced proteolytic stability, Protein Engineering, 1993, vol. 6 , No. 8, pp. 989-995.

Wigginton et al., An immunoglobulin E-reactive chimeric human immunoglobulin G1 anti-idiotype inhibits basophil degranulation through cross-linking of FcεRI with FcγRIIb., Clinical & Experimental Allergy, 38:313-319.

Wong, et al., The Mechanism of Anti-CD3 Monoclonal Antibodies, Transplantation, 1990, vol. 50, No. 4, pp. 683-689.

Woods, et al., LC-MS characterization and purity assessment of a prototype bispecific antibody, mAbs, 2013, vol. 5, Issue 5, pp. 711-722, http://dx.doi.org/10.4161/mabs.25488.

Woyke et al., In vitro activities and postantifungal effects of the potent dolastation 10 derivative auristatin PHE, 2001, Antimicrob. Agents and Chemother. 45(12):3580-3584.

Wu et al., Molectular construction and optimization of anti-human IL-11α/β dual variable domain immunoglobulin (DVD-Ig™) molecules, [mAbs 1:4, 339-347; Jul./Aug. 2009]; Landes Bioscience, Apr. 10, 2009.

Wu et al., Simultaneous targeting of multiple disease mediators by a dual-variable-domain immunoglobulin, (DVD-Ig™) molecules, Jul.-Aug. 2009; 339-347, Oct. 14, 2007.

Wu et al., Humanization of a murine monoclonal antibody by simultaneous optimization of framework and CDR residues, 1999, J. Mol. Biol. 294:151-162.

Wu, et al., Multimerization of a chimeric anti-CD20 single-chain Fv-Fc fusion protein is mediated through variable domain exchange, Protein Engineering, 2001, vol. 14, No. 12, pp. 1025-1033.

Wucherpfennig, et al., Structural Biology of the T-cell Receptor: Insights into Receptor Assembly, Ligand Recognition, and Initiation of Signaling, Cold Spring Harb Perspect Biol 2010;2:a005140.

Xie, et al., A new format of bispecific antibody: highly efficient heterodimerization, expression and tumor cell lysis, Journal of Immunological Methods, 2005, vol. 296 , pp. 95-101, doi:10.1016/j.jim.2004.11.005.

(56) References Cited

OTHER PUBLICATIONS

Xu, et al., Combinatorial surrobody libraries, PNAS, 2008, vol. 105, No. 31, pp. 10756-10761.
Xu, et al., Rapid optimization and prototyping for therapeutic antibody-like molecules, mAbs, 2013, vol. 5, Issue 2, pp. 237-254.
Xu, et al., Surrobodies with Functional Tails, J. Mol. Biol., 2010, vol. 397, pp. 352-360.
Yang et al., Differential in vitro activation of CD8-CD4+ and CD4-CD8+ T lymphocytes by combinations of anti-CD2 and anti-CD3 antibodies, Apr. 1, 1988.
Yelton et al., Affinity maturation of the BR96 anti-carcinoma antibody by codon-based mutagenesis, 1995, J. Immunol. 155:1994-2004.
Yeung, et al., Engineering human IgG1 affinity to human neonatal Fc receptor: impact of affinity improvement on pharmacokinetics in primates, J Immunol. Jun. 15, 2009;182(12):7663-71. doi: 10.4049/jimmunol.0804182.
Yoshino et al., Upgrading of flow cytometric analysis for absolute counts, cytokines and other antigenic molecules of cynomolgus monkeys (*Macaca fascicularis*) by using anti-human cross-reactive antibodies, Exp. Anim., 2000, vol. 49(2), pp. 97-100.
Yu et al., The biosynthetic gene cluster of the maytansinoids antitumor agent ansamitocin from actinosynnema pretiosum, 2002, PNAS 99:7968-7973.
Zalevsky et al. "Enhanced antibody half-life improves in vivo activity." Nature Biotechnology, vol. 28, No. 2, Feb. 1, 2010, pp. 157-159.
Zamyatnin AA., Amino acid, peptide, and protein volume in solution., *Annu Rev Biophys Bioeng.* 1984;13:145-65.
Zeidler, et al., The Fc-region of a new class of intact bispecific antibody mediates activation of accessory cells and NK cells and induces direct phagocytosis of tumour cells, Br J Cancer, 2000, vol. 83(2), pp. 261-266.
Zhu, et al., Identification of Heavy Chain Residues in a Humanized Anti-CD3 Antibody Important for Efficient Antigen Binding and T Cell Activation, The Journal of Immunology, 1995, vol. 155, pp. 1903-1910.
Zhu, et al., Remodeling domain interfaces to enhance heterodimer formation, Protein Science, 1997, vol. 6, pp. 781-788.
Zeibig et al., Effect of the oxLDL Binding Protein Fc-CD68 on Plaque Extension and Vulnerability in Atherosclerosis., Circulation Research 108: 695-703, 2011.
Zuo, et al., An efficient route to the production of an IgG-like bispecific antibody, Protein Engineering, 2000, vol. 13, No. 5, pp. 361-367.
Sun et al., Anti-CD20/CD3 T cell-dependent bispecific antibody for the treatment of B cell malignancies., Science Translational Medicine May 13, 2015: vol. 7, Issue 287, pp. 287ra70 DOI: 10.1126/scitranslmed.aaa480.
Capizzi et al., Curative chemotherapy for acute myeloid leukemia: the development of high-dose ara-C from the laboratory to bedside., Invest New Drugs. 1996;14(3):249-56.
Giles et al., Intravenous corticosteroids to reduce gemtuzumab ozogamicin infusion reactions. Ann Pharmacother. Sep. 2003;37(9):1182-5.
Duong et al., Targeted treatment of acute myeloid leukemia in older adults: role of gemtuzumab ozogamicin., Clin Interv Aging. 2009;4:197-205. Epub May 14, 2009.
Sun et al., Preclinical Characterization of Combinability and Potential Synergy of Anti-CD20/CD3 T-Cell Dependent Bispecific Antibody with Chemotherapy and PD-1/PD-L1 Blockade., Blood 2016 128:4168.
Gantke et al., Trispecific antibodies for CD16A-directed NK cell engagement and dual-targeting of tumor cells., Protein Eng Des Sel. Sep. 1, 2017;30(9):673-684. doi: 10.1093/protein/gzx043.
Zhang et al., The development of bispecific antibodies and their applications in tumor immune escape., Experimental Hematology & Oncology20176:12.
Krupka et al.,Blockade of the PD-1/PD-L1 axis augments lysis of AML cells by the CD33/CD3 BiTE antibody construct AMG 330: reversing a T-cell-induced immune escape mechanism., Leukemia. Feb. 2016;30(2):484-91. doi: 10.1038/leu.2015.214. Epub Aug. 4, 2015.
Osada et al., CEA/CD3-bispecific T cell-engaging (BiTE) antibody-mediated T lymphocyte cytotoxicity maximized by inhibition of both PD1 and PD-L1., Cancer Immunol Immunother. Jun. 2015;64(6):677-88. doi: 10.1007/s00262-015-1671-y. Epub Mar. 6, 2015.
Masarova et al., Immune Checkpoint Approaches in AML and MDS: A Next Frontier?, The Journal of Targeted Therapies in Cancer, Mar. 6, 2017 (Mar. 6, 2017), XP002784099.
Scott et al., Antibody therapy of cancer., Nat Rev Cancer. Mar. 22, 2012;12(4):278-87. doi: 10.1038/nrc3236.
Clynes et al., Redirected T Cell Cytotoxicity in Cancer Therapy., Annu Rev Med. Jan. 27, 2019;70:437-450. doi: 10.1146/annurev-med-062617-035821. Epub Oct. 31, 2018.
Merchant et al., Monovalent antibody design and mechanism of action of onartuzumab, a MET antagonist with anti-tumor activity as a therapeutic agent., Proc Natl Acad Sci U S A. Aug. 6, 2013;110(32):E2987-96. doi: 10.1073/pnas.1302725110. Epub Jul. 23, 2013.
Fos et al., ICOS ligation recruits the p50alpha PI3K regulatory subunit to the immunological synapse., J Immunol. Aug. 1, 2008;181(3):1969-77.
Sanmamed et al., Agonists of Co-stimulation in Cancer Immunotherapy Directed Against CD137, OX40, GITR, CD27, CD28, and ICOS., Semin Oncol. Aug. 2015;42(4):640-55. doi: 10.1053/j.seminoncol. 2015.05.014. Epub Jun. 11, 2015.
Vieira et al., ICOS-mediated signaling regulates cytokine production by human T cells and provides a unique signal to selectively control the clonal expansion of Th2 helper cells., Eur J Immunol. May 2004;34(5):1282-90.
Carpenter et al., Activation of human B cells by the agonist CD40 antibody CP-870,893 and augmentation with simultaneous toll-like receptor 9 stimulation., J Transl Med. Nov. 11, 2009;7:93. doi: 10.1186/1479-5876-7-93.
Gilboa et al., Use of oligonucleotide aptamer ligands to modulate the function of immune receptors., Clin Cancer Res. Mar. 1, 2013;19(5):1054-62. doi: 10.1158/1078-0432.CCR-12-2067.
Uy et al., Preliminary Results of a Phase 1 Study of Flotetuzumab, a CD123×CD3 Bispecific Dart® Protein, in Patients with Relapsed/Refractory Acute Myeloid Leukemia and Myelodysplastic Syndrome., Blood 2017 130:637.
Vey et al., Interim Results from a Phase 1 First-in-Human study of flotetuzumab, a CD123×CD3 bispecific DART molecule, in AML/MDS., Annals of Oncology (2017) 28 (suppl_5): v355-v371. 10.1093/annonc/mdx373.
Ravandi et al., Complete Responses in Relapsed/Refractory Acute Myeloid Leukemia (AML) Patients on a Weekly Dosing Schedule of XmAb14045, a CD123×CD3 T Cell-Engaging Bispecific Antibody: Initial Results of a Phase 1 Study., Blood 2018 132:763; doi: https://doi.org/10.1182/blood-2018-99-119786.
Bernett et al., Multiple Bispecific Checkpoint Combinations Promote T cell activation., Nov. 11, 2016, retrieved from the internet: http://files.shareholder.com/downloads/AMDA-2B2V8N/0x0x916283/67AE1A8B-40E8-4316-9F79-384D06B2C395/XNCR_SITC_2016_PD1xCTLA4_Poster126_12Nov2016.pdf.
Chichili et al., Co-targeting of PD-1 and CTLA-4 Inhibitory Pathways with Bispecific DART® and TRIDENT™ Molecules., Apr. 4, 2017, retrieved from the internet: http://files.shareholder.com/downloads/AMDA-278VRP/0x0x935572/8CC86417-40BA-41C0-935D-EF1B7DB0B5BB/AACR_2017_-_Co-targeting_PD-1_and_CTLA-4_Inhibitory_Pathways_with_DART_and_TRIDENT_Molecules.pdf.
"Hedvat et al., Dual Blockade of PD-1 and CTLA-4 with Bispecific Antibodies Promotes Human T cell Activation and Proliferation., Nov. 11, 2016, retrieved from the internet: http://files.shareholder.com/downloads/AMDA-2B2V8N/0x0x916284/D8084990-61EC-4DFE-8B76-60CF58B8C06F/CPI_bispecifics.pdf".
Ott et al., CTLA-4 and PD-1/PD-L1 blockade: new immunotherapeutic modalities with durable clinical benefit in melanoma patients., Clin Cancer Res. Oct. 1, 2013;19(19):5300-9. doi: 10.1158/1078-0432. CCR-13-0143.

(56) References Cited

OTHER PUBLICATIONS

Spranger et al., Mechanism of tumor rejection with doublets of CTLA-4, PD-1/PD-L1, or IDO blockade involves restored IL-2 production and proliferation of CD8(+) T cells directly within the tumor microenvironment., J Immunother Cancer. Feb. 18, 2014;2:3. doi: 10.1186/2051-1426-2-3. eCollection 2014.

Madrenas et al., Conversion of CTLA-4 from inhibitor to activator of T cells with a bispecific tandem single-chain Fv ligand., J Immunol. May 15, 2004;172(10):5948-56.

Yokosuka et al., Spatiotemporal basis of CTLA-4 costimulatory molecule-mediated negative regulation of T cell activation., Immunity. Sep. 24, 2010;33(3):326-39. doi: 10.1016/j.immuni.2010.09.006.

Fan et al., Engagement of the ICOS pathway markedly enhances efficacy of CTLA-4 blockade in cancer immunotherapy., J Exp Med. Apr. 7, 2014;211(4):715-25. doi: 10.1084/jem.20130590. Epub Mar. 31, 2014.

Larkin, J. et al. (2015) Combined Nivolumab and Ipilimumab or Monotherapy in Untreated Melanoma. The New England Journal of Medicine 373(1); 23-34 (Year: 2015).

Postow, M.A., et al. (2015) Nivolumab and Ipilimumab versus Ipilimumab in Untreated Melanoma The New England Journal of Medicine 372; 2006-2017 (Year: 2015).

Hodi, F.S., et al. (2017) Two-year overall survival rates from a randomised phase 2 trial evaluating the combination of nivolumab and ipilimumab versus ipilimumab alone in patients with advanced melanoma Lancet Oneal. 17(11 ); 1558-1568 (Year: 2017).

Sheng, J., et al. (2017) Clinical Pharmacology Considerations for the Development of Immune Checkpoint Inhibitors The Journal of Clinical Pharmacology 57(S1 O); S26-S42 (Year: 2017).

Srivastava, P., et al. (2018) Primary amelanotic malignant melanoma of cervix masquerading as squamous cell carcinoma presenting with extensive metastases. BMJ Case Rep (10) 1-4 (Year: 2018).

Lichtenegger et al., Targeting LAG-3 and PD-1 to Enhance T Cell Activation by Antigen-Presenting Cells., Front. Immunol. Feb. 27, 2018; 9: 385; pp. 1-12.

Liang et al., Targeting IFNα to tumor by anti-PD-L1 creates feedforward antitumor responses to overcome checkpoint blockade resistance ., Nat. Commun. Nov. 2, 2018; 9 (1): 4586.

Chen et al., Therapeutic efficacy of an anti-PD-L1 antibody based immunocytokine in a metastatic mouse model of colorectal cancer ., Biochem. Biophys. Res. Commun. Nov. 11, 2016; 480 (2): 160-5.

\* cited by examiner

Bottle-opener

Dual scFv

One-arm central-scFv

One-arm scFv-mAb

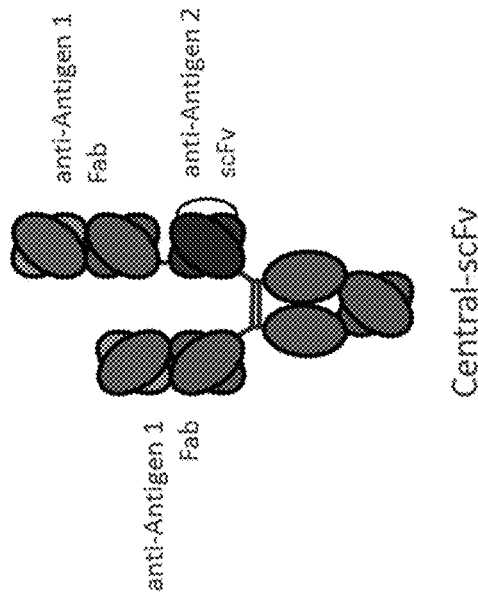
FIG. 1F — Central-scFv
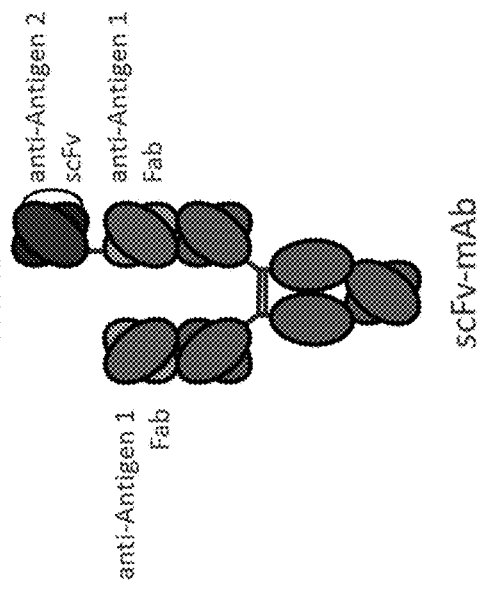
FIG. 1E — scFv-mAb
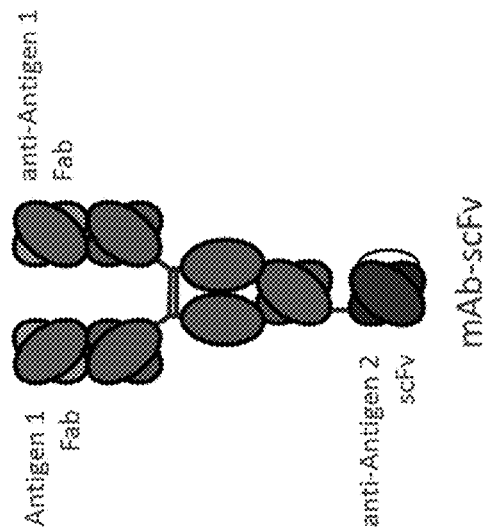
FIG. 1H — mAb-scFv
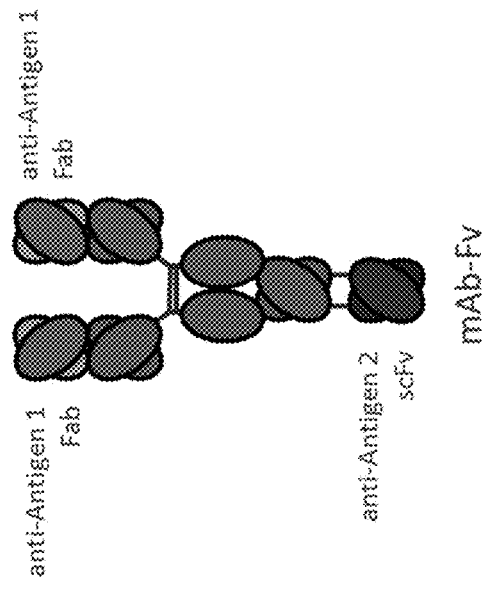
FIG. 1G — mAb-Fv

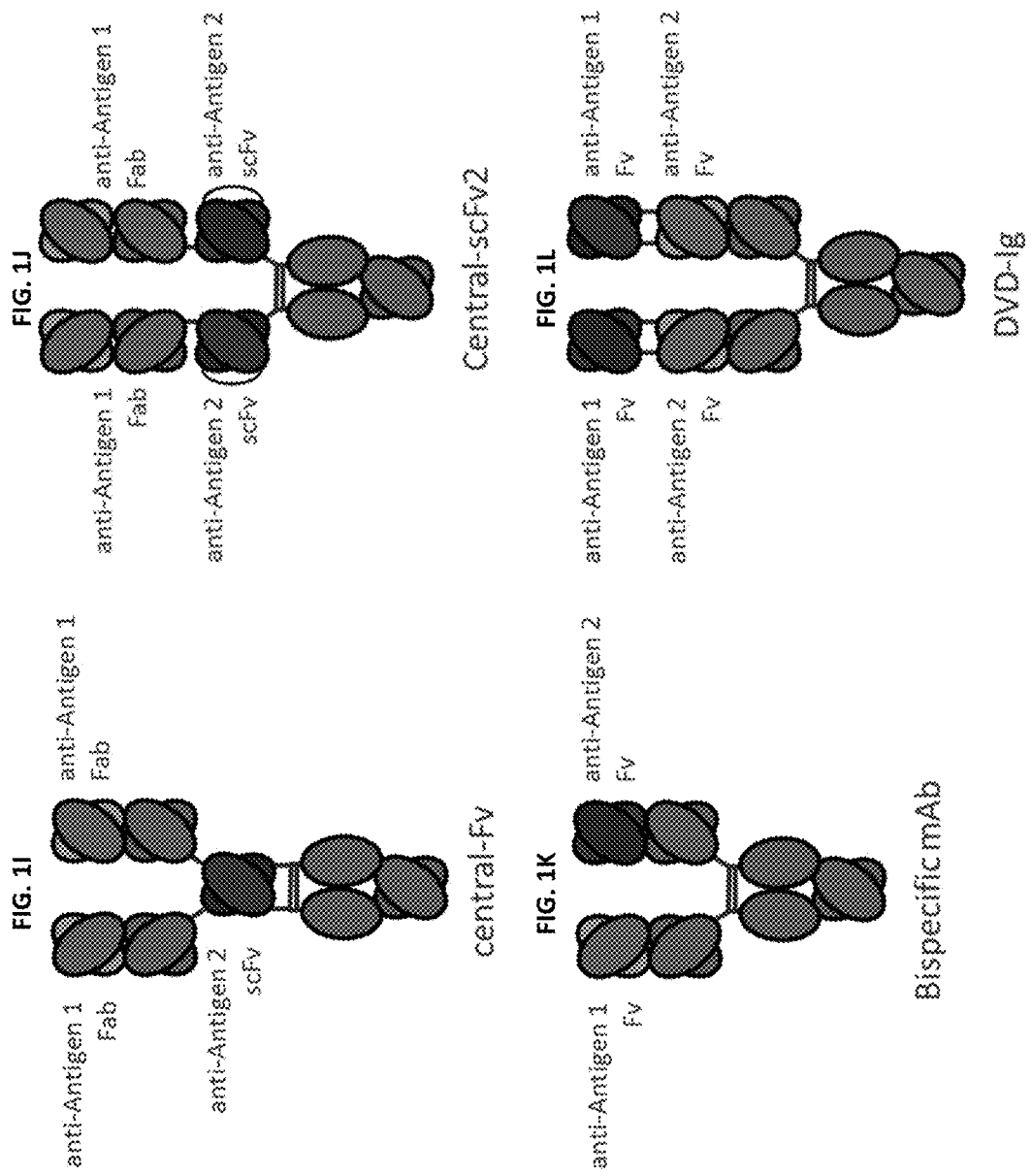

One-arm mAb anti-Antigen 2 Fab

Trident anti-Antigen 1 Fab anti-Antigen 2 scFv anti-Antigen 1 scFv anti-Antigen 2 scFv mAb-(scFv)2

FIG. 2A
antigen sequences

Human PD-1 sequence

>sp|Q15116 SEQ ID NO: 39182
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLENGRDFHMSVVRARRNDSG
TYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPP
VPCVPEQTEYATIVFPSGMGTSSPARRGSADGPRSAQPLRPEDGHCSWPL

Human PD-1 sequence, extracellular domain

>sp|Q15116|21-170 SEQ ID NO: 39183
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLR
AELRVTERRAEVPTAHPSPSPRPAGQFQTLV

Macaca fascicularis PD-1 sequence

>tr|B0LAJ3 SEQ ID NO: 39184
MQIPQAPWPVVWAVLQLGWRPGWFLESPDRPWNAPTFSPALLVVTEGDNATFTCSFSNASESFVLNWYRMSPSNQTDKLAAFPEDRSQPGQDCRFRVTRLPNGRDFHMSVVRARRNDSG
TYLCGAISLAPKAQIKESLRAELRVTERRAEVPTAHPSPSGLGSIVLLVWVLAVICSRAAQGTIEARRTGQPLKEDPSAVPVFSVDYGELDFQWREKTPEPP
APCVPEQTEYATIVFPSGLGTSSPARRGSADGPRSPRPLRPEDGHCSWPL

Macaca fascicularis PD-1 sequence, extracellular domain (predicted)

>tr|B0LAJ3|21-170 SEQ ID NO: 39185
PGWFLESPDRPWNAPTFSPALLVVTEGDNATFTCSFSNASESFVLNWYRMSPSNQTDKLAAFPEDRSQPGQDCRFRVTRLPNGRDFHMSVVRARRNDSGTYLCGAISLAPKAQIKESLR
AELRVTERRAEVPTAHPSPSPRPAGQFQALV

Human CTLA-4 sequence

>sp|P16410 SEQ ID NO: 39186
MACLGFQRHKAQLNLATRTWPCTLLFFLLFIPVFCKAMHVAQPAVVLASSRGIASFVCEYASPGKATEVRVTVLRQADSQVTEVCAATYMMGNELTFLDDSICTGTSSGNQVNLTIQGL
RAMDTGLYICKVELMYPPPYYLGIGNGTQIYVIDPIN

Human CTLA-4 sequence, extracellular domain

>sp|P16410|36-161 SEQ ID NO: 39187
KAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDP
EPCPDSD

FIG. 2B

Macaca fascicularis CTLA-4 sequence

>tr|G7PL88 SEQ ID NO: 39188
MACLGFQRHKARLNLATRTRPYTLLFSLLFIPVFSKAMHVAQPAVVLANSRGIASFVCEYASPGKATEVRVTVLRQADSQVTEVCAATYMMGNELTFLDDSICTGTSSGNQVNLTIQGL
RAMDTGLYICKVELMYPPPYMGIGNGTQIYVIDPEPCPDSDFLLWILAAVSSGLFFYSFLLTAVSLSKMLKKRSPLTTGVYVKMPPTEPECEKQFQPYFIPIN

Macaca fascicularis CTLA-4 sequence, extracellular domain (predicted)

>tr|G7PL88 SEQ ID NO: 39189
KAMHVAQPAVVLANSRGIASFVCEYASPGKATEVRVTVLRQADSQVTEVCAATYMMGNELTFLDDSICTGTSSGNQVNLTIQGLRAMDTGLYICKVELMYPPPYMGIGNGTQIYVIDP
EFCPDSD

Human LAG-3 sequence

>sp|P18627 SEQ ID NO: 39190
MWEAQFLGLLFLQPLWVAPVKPLQPGAEVPVVWAQEGAPAQLPCSPTIPLQDLSLLRRAGVTWQHQPDSGPPAAAPGHPLAPGPHPAAPSSWGPRPRRYTVLSVGPGGLRSGRLPLQPR
VQLDERGRQRGDFSLWLRPARRADAGEYRAAVHLRDRALSCRLRLRLGQASMTASPPGSLRASDWVILNCSFSRPDRPASVHWFRNRGQGRVPVRESPHHHLAESFLFLPQVSPMDSGP
WGCILTYRDGFNVSIMYNLTVLGLEPPTPLTVYAGAGSRVGLPCRLPAGVGTRSFLTAKWTPPGGGPDLLVTGDNGDFTLRLEDVSQAQAGTYTCHIHLQEQQLNATVTLAIITVTPKS
FGSPGSLGKLLCEVTPVSGQERFVWSSLDTPSQRSFSGPWLEAEAQLLSQPWQCQLYQGERLLGAAVYFTELSSPGAQRSGRAPGALPAGHLLLFLILGVLSLLLLVTGAFGFHLWRR
QWRPRRFSALEQGIHPPQAQSKIEELEQEPEPEPEPEPEPEPEPEQL

Human LAG-3 sequence, extracellular domain

>sp|P18627|29-450 SEQ ID NO: 39191
MWEAQFLGLLFLQPLWVAPVKPLQPGAEISVVWAQEGAPAQLPCSPTIPLQDLSLLRRAGVTWQHQPDSGPPAAAPGHPLAPGPHPAAPSSWGPRPRRYTVLSVGPGGLRSGRLPLQPRVQLDERGRQRGDFSLWLRPARRADAGEY
RAAVHLRDRALSCRLRLRLGQASMTASPPGSLRASDWVILNCSFSRPDRPASVHWFRNRGQGRVPVRESPHHHLAESFLFLPQVSPMDSGPWGCILTYRDGFNVSIMYNLTVLGLEPPT
PLTVYAGAGSRVGLPCRLPAGVGTRSFLTAKWTPPGGGPDLLVTGDNGDFTLRLEDVSQAQAGTYTCHIHLQEQQLNATVTLAIITVTPKSFGSPGSLGKLLCEVTPVSGQERFVWSSL
DTPSQRSFSGPWLEAEAQLLSQPWQCQLYQGERLLGAAVYFTELSSPGAQRSGRAPGALPAGHL

Macaca fascicularis LAG-3 sequence (predicted)

>gi|544467815|ref|XP_005570011.1  SEQ ID NO: 39192
MWEAQFLGLLFLQPLWVAPVKPPQPGAEISVVWAQEGAPAQLPCSPTIPLQDLSLLRRAGVTWQHQPDSGPPAAXAPGHPPVPGHRPAAPYSWGPRPRRYTVLSVGPGGLRSGRLPLQPR
VQLDERGRQRGDFSLWLRPARRADAGEYRATVHLRDRALSCRLRLRVGQASMTASPPGSLRTSDWVILNCSFSRPDRPASVHWFRSRGQGRVPVQGSPHHHLAESFLFLPHVGPMDSGL
WGCILTYRDGFNVSIMYNLTVLGLEPATPLITVAGAGSRVELPCRLPPAVGTQSFLTAKWAPPGGGPDFTLRLEDVSQAQAGTYICHIRLQGGQLNATVTLAIITVTPKS
FGSPGSLGKLLCEVTPASGQEHFVWSPLNTPSQRSFSGPWLEAEAQLLSQPWQCQLHQGERLLGAAVYFTELSSPGAQRSGRAPGALRAGHLPLFLILGVLFLLLVTGAFGFHLWRR
QWRPRRFSALEQGIHPPQAQSKIEELEQEPELEPELERELGPEPEPGPEPEPEQL

FIG. 2C

Macaca fascicularis LAG-3 sequence, extracellular domain (predicted)

>gi|544467815|ref|XP_005570011.1|29-450 SEQ ID NO: 39193
ISVVWAQEGAPAQLPCSPTIPLQDLSLLRRAGVTWQHQPDSGPPAXAPGHPPVEGHRPAAPYSWGPREPRRYTVLSVGPGGLRSGRLPLQPRVQLDERGRQRGDFSLWLRPARRADAGEY
RATVHLRDRALSCRLRLRVGQASMTASPPGSLRTSDWVILNCSFSRPDRPASVHWFRSRQGGRVPVQGSPHHHLAESFLFLPHVGPMDSGLWGCILTYRDGFNVSIMYNLTVLGLEPAT
PLTVYAGAGSSRVELPCRLPPAVGTQSFLTAKWAPPGGGPDLLVAGDNGDFTIRLEDVSQAQAGTYICHIRLQGGQQLNATVTLAIITVTPKSFGSPGSLGKLLCEVTPASGQEHFVWSPL
NTPSQRSFSGPWLEAQEAQLLSQPWQCQLHQGERLLGAAVYFTELSSPGAQRSGRAPGALRAGHL

Human BTLA sequence

>sp|Q7Z6A9| SEQ ID NO: 39194
MKTLPAMLGTGKLFWVFFLIPYLDIWNIHGKESCDVQLYIKRQSEHSILAGDPFELECPVKYCANRPHVTWCKLNGTTCVKLEDRQTSWKEEKNISFFILHFEPVLPNDNGSYRCSANF
QSNLIESHSTTLYVTDVKSASERPSKDEMASRPWLLYRLLPLGGLPLLITTCFCLFCCLRRHQGKQNELSDTAGREINLVDAHLKSEQTEASTRQNSQVLLSETGIYDNDPDLCFRMQE
GSEVYSNPCLEENKPGIVYASLNHSVIGPNSRLARNVKEAPTEYASICVRS

Human BTLA sequence, extracellular domain

>sp|Q7Z6A9|31-157 SEQ ID NO: 39195
KESCDVQLYIKRQSEHSILAGDPFELECPVKYCANRPHVTWCKLNGTTCVKLEDRQTSWKEEKNISFFILHFEPVLPNDNGSYRCSANFQSNLIESHSTTLYVTDVKSASERPSKDEMA
SRPWLLYR

Macaca fascicularis BTLA sequence (predicted)

>gi|355574640|gb|EHH51020.1| SEQ ID NO: 39196
MKTLPAMLGSSGRLFWVFLIPYLDIWNIHGKESCDVQLYIKRQSYHSIFAGDRFKLECPVKYCAHRPQVTWCKLNGTTCVKLEGRHTSWKQEKNLSFFILHFEPVLPSDNGSYRCSANF
LSAIIESHSTTLYVTDVKSASERPSKDEMASRPWLLYSLLPLGGLPLLITTCFCLFCFLRRHQGKQNELSDTTRREITLVDVPFKSEQTEASTRQNSQVLLSETGIYDNEPDFCFRMQE
GSEVYSNPCLEENKPGIIYASLNHSIIGLNARQARNVKEAPTEYASICVRS

Macaca fascicularis BTLA sequence, extracellular domain (predicted)

>gi|355574640|gb|EHH51020.1|31-157 SEQ ID NO: 39197
KESCDVQLYIKRQSYHSIFAGDRFKLECPVKYCAHRPQVTWCKLNGTTCVKLEGRHTSWKQEKNLSFFILHFEPVLPSDNGSYRCSANFLSAIIESHSTTLYVTDVKSASERPSKDEMA
SRPWLLYS

Human TIM-3 sequence

>sp|Q8TDQ0| SEQ ID NO: 39198
MFSHLPFDCVLLLLLLLLLTRSSEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMN
DEKFNLKLVIKPAKVTPAPTRQRDFTAAFPRMLTTRGHGPAETQTLGSLPDINLTIQSTLANELRDSRLANDLRDSGATIRIGIYIGAGICAGLALALIFGALIFKWYSHSKEKIQNLS
LISLANLPPSGLANAVAEGIRSEENIYTIEENVYEVEEPNEYYCYVSSRQQPSQPLGCRFAM

FIG. 2D

Human TIM-3 sequence, extracellular domain

>sp|Q8TDQ0|122-202 SEQ ID NO: 39199
SEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPAKVTPAPTR
QRDFTAAFPRMLTTRGHGPAETQTLGSLPDINLTQISTLANELRDSRLANDLRDSGATIRIG

Macaca fascicularis TIM-3 sequence (predicted)

>gi|355750365|gb|EHH54703.1 SEQ ID NO: 39200
MFSHLPFDCVLLLLLLLTRSSEVEYIAEVGQNAYLPCSYTPAPPGNLVPVCWGKGACPVFDCSNVVLRTDNRDVNDRTSGRYWLKGDFHKGDVSLTTIENVTLADSGVYCCRIQIQIPGIM
NDEKHNVKLVVIKPAKVTPAPTLQRDLTSAFPRMLTTGEHGPAETQTPGSLPDVNLTVSNFFCELQIFTLTNELRDSGATIRTAIYIAAGISAGLALALIFGALIFKWYSHSKEKTQNL
SLISLANIPPSGLANAVAEGIRSEENIYTIEEDVYEVEEPNEYYCYVSSGQQPSQPLGCRVAMP

Macaca fascicularis TIM-3 sequence, extracellular domain (predicted)

>gi|355750365|gb|EHH54703.1|22-203 SEQ ID NO: 39201
SEVEYIAEVGQNAYLPCSYTPAPPGNLVPVCWGKGACPVFDCSNVVLRTDNRDVNDRTSGRYWLKGDFHKGDVSLTIENVTLADSGVYCCRIQIPGIMNDEKHNVKLVVIKPAKVTPAP
TLQRDLTSAFPRMLTTGEHGPAETQTPGSLPDVNLTVSNFFCELQIFTLTNELRDSGATIRTA

FIG. 3A
skew variants

| Monomer 1 | Monomer 2 |
|---|---|
| F405A | T394F |
| S364D | Y349K |
| S364E | L368K |
| S364E | Y349K |
| S364F | K370G |
| S364H | Y349K |
| S364H | Y349T |
| S364Y | K370G |
| T411K | K370E |
| V397S/F405A | T394F |
| K370R/T411K | K370E/T411E |
| L351E/S364D | Y349K/L351K |
| L351E/S364E | Y349K/L351K |
| L351E/T366D | L351K/T366K |
| P395T/V397S/F405A | T394F |
| S364D/K370G | S364Y/K370R |
| S364D/T394F | Y349K/F405A |
| S364E/F405A | Y349K/T394F |
| S364E/F405S | Y349K/T394Y |
| S364E/T411E | Y349K/D401K |
| S364H/D401K | Y349T/T411E |
| S364H/F405A | Y349T/T394F |
| S364H/T394F | Y349T/F405A |
| Y349C/S364E | Y349K/S354C |
| L351E/S364D/F405A | Y349K/L351K/T394F |
| L351K/S364H/D401K | Y349T/L351E/T411E |
| S364E/T411E/F405A | Y349K/T394F/D401K |
| S364H/D401K/F405A | Y349T/T394F/T411E |
| S364H/F405A/T411E | Y349T/T394F/D401K |

FIG. 3B

| Monomer 1 | Monomer 2 |
|---|---|
| K370E/T411D | T411K |
| L368E/K409E | L368K |
| Y349T/T394F/S354C | S364H/F405A/Y349C |
| T411E | D401K |
| T411E | D401R/T411R |
| Q347E/K360E | Q347R |
| L368E | S364K |
| L368E/K370S | S364K |
| L368E/K370T | S364K |
| L368E/D401R | S364K |
| L368E/D401N | S364K |
| L368E | E357S/S364K |
| L368E | S364K/K409E |
| L368E | S364K/K409V |
| L368D | S364K |
| L368D/K370S | S364K |
| L368D/K370S | S364K/E357L |
| L368D/K370S | S364K/E357Q |
| T411E/K360E/Q362E | D401K |
| K370S | S364K |
| L368E/K370S | S364K/E357Q |
| K370S | S364K/E357Q |
| T411E/K360D | D401K |
| T411E/K360E | D401K |
| T411E/Q362E | D401K |
| T411E/N390D | D401K |
| T411E | D401K/Q347K |
| T411E | D401K/Q347R |
| T411E/K360D/Q362E | D401K |

FIG. 3C

| Monomer 1 | Monomer 2 |
|---|---|
| K392D/K409D | E356K/D399K |
| K370D/K392D/K409D | E356K/E357K/D399K |
| I199T/N203D/K247Q/R355Q/N384S/K392N/V397M/Q419E/K447_ | Q196K/I199T/P217R/P228R/N276K |
| I199T/N203D/K247Q/R355Q/N384S/K392N/V397M/Q419E/K447_ | Q196K/I199T/N276K |
| N384S/K392N/V397M/Q419E | N276K |
| D221E/P228E/L368E | D221R/P228R/K409R |
| C220E/P228E/L368E | C220R/E224R/P228R/K409R |
| F405L | K409R |
| T366I/K392M/T394W | F405A/Y407V |
| T366V/K409F | L351Y/Y407A |
| T366A/K392E/K409F/T411E | D399R/S400R/Y407A |
| L351K | L351E |
| I199T/N203D/K247Q/R355Q/Q419E/K447_ | Q196K/I199T/P217R/P228R/N276K |
| I199T/N203D/K247Q/R355Q/Q419E/K447_ | Q196K/I199T/N276K |
| I199T N203D K274Q R355Q N384S K392N V397M Q419E DEL447 | |
| N208D Q295E N384D Q418E N421D | |
| N208D Q295E Q418E N421D | |
| Q196K I199T P217R P228R N276K | |
| Q196K I199T N276K | |
| E269Q E272Q E283Q E357Q | |
| E269Q E272Q E283Q | |
| E269Q E272Q | |
| E269Q E283Q | |
| E272Q E283Q | |
| E269Q | |

FIG. 3D

| Monomer 1 | Monomer 2 |
|---|---|
| T411E/K360E/N390D | D401K |
| T411E/Q362E/N390D | D401K |
| T411E/Q347R | D401K/K360D |
| T411E/Q347R | D401K/K360E |
| T411E/K360 | D401K/Q347K |
| T411E/K360D | D401K/Q347R |
| T411E/K360E | D401K/Q347K |
| T411E/K360E | D401K/Q347R |
| T411E/S364K | D401K/K370S |
| T411E/K370S | D401K/S364K |
| Q347E | E357Q |
| Q347E | E357Q/Q362K |
| K360D/Q362E | Q347R |
| K360D/Q362E | D401K |
| K360D/Q362E | Q347R/D401K |
| K360E/Q362E | Q347R |
| K360E/Q362E | D401K |
| K360E/Q362E | Q347R/D401K |
| Q362E/N390D | D401K |
| Q347E/K360D | D401N |
| K360D | Q347R/N390K |
| K360D | N390K/D401N |
| K360E | Y349H |
| K370S/Q347E | S364K |
| K370S/E357L | S364K |
| K370S/E357Q | S364K |
| K370S/Q347E/E357L | S364K |
| K370S/Q347E/E357Q | S364K |

FIG. 3E

| Monomer 1 | Monomer 2 |
|---|---|
| L368D/K370S/Q347E | S364K |
| L368D/K370S/E357L | S364K |
| L368D/K370S/E357Q | S364K |
| L368D/K370S/Q347E/E357L | S364K |
| L368D/K370S/Q347E/E357Q | S364K |
| L368E/K370S/Q347E | S364K |
| L368E/K370S/E357L | S364K |
| L368E/K370S/E357Q | S364K |
| L368E/K370S/Q347E/E357L | S364K |
| L368E/K370S/Q347E/E357Q | S364K |
| L368D/K370T/Q347E | S364K |
| L368D/K370T/E357L | S364K |
| L368D/K370T/E357Q | S364K |
| L368D/K370T/Q347E/E357L | S364K |
| L368D/K370T/Q347E/E357Q | S364K |
| L368E/K370T/Q347E | S364K |
| L368E/K370T/E357L | S364K |
| L368E/K370T/E357Q | S364K |
| L368E/K370T/Q347E/E357L | S364K |
| L368E/K370T/Q347E/E357Q | S364K |
| T411E/Q362E | D401K/T411K |
| T411E/N390D | D401K/T411K |
| T411E/Q362E | D401R/T411R |
| T411E/N390D | D401R/T411R |
| Y407T | T366Y |
| F405A | T394W |
| T366Y/F405A | T394W/Y407T |
| Y407A | T366W |
| T366S/L368A/Y407V | T366W |

FIG. 3F

| Monomer 1 | Monomer 2 |
|---|---|
| T366S/L368A/Y407V/Y349C | T366W/S354C |
| K392D/K409D | E356K/D399K |
| K370D/K392D/K409D | E356K/E357K/D399K |
| I199T/N203D/K247Q/R355Q/N384S/K392N/V397M/Q419E/K447_ | Q196K/I199T/P217R/P228R/N276K |
| I199T/N203D/K247Q/R355Q/N384S/K392N/V397M/Q419E/K447_ | Q196K/I199T/N276K |
| N384S/K392N/V397M/Q419E | N276K |
| D221E/P228E/L368E | D221R/P228R/K409R |
| C220E/P228E/L368E | C220R/E224R/P228R/K409R |
| F405L | K409R |
| T366I/K392M/T394W | F405A/Y407V |
| T366V/K409F | L351Y/Y407A |
| T366A/K392E/K409F/T411E | D399R/S400R/Y407A |
| L351K | L351E |
| I199T/N203D/K247Q/R355Q/Q419E/K447_ | Q196K/I199T/P217R/P228R/N276K |
| I199T/N203D/K247Q/R355Q/Q419E/K447_ | Q196K/I199T/N276K |
| I199T N203D K274Q R355Q N384S K392N V397M Q419E DEL447 | |
| N208D Q295E N384D Q418E N421D | |
| Q295E N384D Q418E N421D | |
| N208D Q295E Q418E N421D | |
| Q295E Q418E N421D | |
| Q196K I199T P217R P228R N276K | |
| Q196K I199T N276K | |
| E269Q E272Q E283Q E357Q | |
| E269Q E272Q E283Q | |
| E269Q E272Q | |
| E269Q E283Q | |
| E272Q E283Q | |
| E269Q | |

FIG. 4
pI variants

| Variant constant region | Substitutions |
|---|---|
| pI_ISO(-) | I199T N203D K274Q R355Q N384S K392N V397M Q419E DEL447 |
| pI_(-)_isosteric_A | N208D Q295E N384D Q418E N421D |
| pI_(-)_isosteric A-Fc only | Q295E N384D Q418E N421D |
| pI_(-)_isosteric_B | N208D Q295E Q418E N421D |
| pI_(-)_isosteric_B-Fc only | Q295E Q418E N421D |
| | |
| pI_ISO(+RR) | Q196K I199T P217R P228R N276K |
| pI_ISO(+) | Q196K I199T N276K |
| pI_(+)_isosteric_A | E269Q E272Q E283Q E357Q |
| pI_(+)_isosteric_B | E269Q E272Q E283Q |
| pI_(+)_isosteric_E269Q/E272Q | E269Q E272Q |
| pI_(+)_isosteric_E269Q/E283Q | E269Q E283Q |
| pI_(+)_isosteric_E272Q/E283Q | E272Q E283Q |
| pI_(+)_isosteric_E269Q | E269Q |

FIG. 5
Ablation variants

| Variant | Variant(s), cont. |
|---|---|
| G236R | P329K |
| S239G | A330L |
| S239K | A330S/P331S |
| S239Q | I332K |
| S239R | I332R |
| V266D | V266D/A327Q |
| S267K | V266D/P329K |
| S267R | S267R/A327Q |
| H268K | S267R/P329K |
| E269R | G236R/L328R |
| 299R | E233P/L234V/L235A/G236del/S239K |
| 299K | E233P/L234V/L235A/G236del/S267K |
| K322A | E233P/L234V/L235A/G236del/S239K/A327G |
| A327G | E233P/L234V/L235A/G236del/S267K/A327G |
| A327L | E233P/L234V/L235A/G236del |
| A327N | S239K/S267K |
| A327Q | 267K/P329K |
| L328E | |
| L328R | |
| P329A | |
| P329H | |

FIG. 6A
useful combinations

| scFv monomer (+) | Fab monomer (-) |
|---|---|
| Heterodimer pI variants S364K/E357Q | Heterodimerization pI variants L368D/K370S |
| Optional scFv charged linker including but not limited to (GKPGS)$_4$ (SEQ ID NO: 39202) | Isosteric pI substitutions N208D/Q295E/N384D/Q418E/N421D |
| FcKO E233P/L234V/L235A/G236del/S267K | FcKO E233P/L234V/L235A/G236del/S267K |
| ± 428L/434S for FcRn | ± 428L/434S for FcRn |
| scFv of ABD of first checkpoint inhibitor (anti-PD-1) | Fv/Fab of the ABD of second checkpoint inhibitor |

FIG. 6B

| scFv monomer | Fab monomer |
|---|---|
| Heterodimer pI variants S364K/E357Q | Heterodimerization pI variants L368D/K370S |
| Optional scFv charged linker including, but not limited to (GKPGS)$_4$(SEQ ID NO: 39202) | pI substitutions I199T N203D K274Q R355Q Q419E K447del |
| FcKO E233P/L234V/L235A/G236del/S267K | FcKO E233P/L234V/L235A/G236del/S267K |
| ± 428L/434S for FcRn (optional) | ± 428L/434S for FcRn (optional) |
| scFv of ABD of first checkpoint inhibitor (anti-PD-1) | Fv/Fab of the ABD of second checkpoint inhibitor |

FIG. 7A
Linkers

Positive charged scFv linkers

| Name | Sequence | Length | Charge | SEQ ID NO: |
|---|---|---|---|---|
| Gly-Ser 15 | GGGGSGGGGSGGGGS | 15 | 0 | 39203 |
| Whitlow linker | GSTSGSGKPGSGEGSTKG | 18 | +1 | 39204 |
| 6paxA_1 (+A) | IRPRAIGGSKPRVA | 14 | +4 | 39205 |
| +B | GKGGSGKGGSGKGGS | 15 | +3 | 39206 |
| +C | GGKGSGGKGSGGKGS | 15 | +3 | 39207 |
| +D | GGGKSGGGKSGGGKS | 15 | +3 | 39208 |
| +E | GKGKSGKGKSGKGKS | 15 | +6 | 39209 |
| +F | GGGKSGGKGSGKGGS | 15 | +3 | 39210 |
| +G | GKPGSGKPGSGKPGS | 15 | +3 | 39211 |
| +H | GKPGSGKPGSGKPGSGKPGS | 20 | +4 | 39202 |
| +I | GKGKSGKGKSGKGKSGKGKS | 20 | +8 | 39212 |

Negative charged scFv linkers

| Name | Sequence | Length | Charge | SEQ ID NO: |
|---|---|---|---|---|
| Gly-Ser 15 | GGGGSGGGGSGGGGSGGGGS | 20 | 0 | 39213 |
| 3hsc_2 (-A) | STAGDTHLGGEDFD | 14 | -4 | 39214 |
| -B | GEGGSGEGGSGEGGS | 15 | -3 | 39215 |
| -C | GGEGSGGEGSGGEGS | 15 | -3 | 39216 |
| -D | GGGESGGGESGGGES | 15 | -3 | 39217 |
| -E | GEGESGEGESGEGES | 15 | -6 | 39218 |
| -F | GGGESGGEGSGEGGS | 15 | -3 | 39219 |
| -G | GEGESGEGESGEGESGEGES | 20 | -8 | 39220 |

FIG. 7B scFv Linkers

| | |
|---|---|
| GGGGSGGGGSGGGGS | (SEQ ID NO: 39203) |
| GGGGSGGGGSGGGGSGGGGS | (SEQ ID NO: 39213) |
| GSTSGSGKPGSGEGSTKG | (SEQ ID NO: 39204) |
| PRGASKSGSASQTGSAPGS | (SEQ ID NO: 39221) |
| GTAAAGAGAAGGAAAGAAG | (SEQ ID NO: 39222) |
| GTSGSSGSGSGGSGSGGGG | (SEQ ID NO: 39223) |
| GKPGSGKPGSGKPGSGKPGS | (SEQ ID NO: 39202) |

FIG. 8
Tms of skews

| XENP | Heterodimer-skewing variant, Chain 1 | Heterodimer-skewing variant, Chain 2 | Heterodimer Yield (%) | CH3 Tm (°C) |
|---|---|---|---|---|
| 12757 | none | none | 52.7 | 83.1 |
| 12758 | L368D/K370S | S364K | 94.4 | 76.6 |
| 12759 | L368D/K370S | S364K/E357L | 90.2 | 77.2 |
| 12760 | L368D/K370S | S364K/E357Q | 95.2 | 77.5 |
| 12761 | T411E/K360E/Q362E | D401K | 85.6 | 80.6 |
| 12496 | L368E/K370S | S364K | 91.5 | n.d. |
| 12511 | K370S | S364K | 59.9 | n.d. |
| 12840 | L368E/K370S | S364K/E357Q | 59.5 | n.d. |
| 12841 | K370S | S364K/E357Q | 90.4 | n.d. |
| 12894 | L368E/K370S | S364K | 41.0 | n.d. |
| 12895 | K370S | S364K | 49.3 | n.d. |
| 12896 | L368E/K370S | S364K/E357Q | 73.9 | n.d. |
| 12901 | K370S | S364K/E357Q | 87.9 | n.d. |

FIG. 9

XENP021575 1C11[PD-1]_H0L0_IgG1_PVA_/S267K Heavy Chain (SEQ ID NOS 39224-39228)
QIQLVQSGPELKKPGETVKISCRASGYTFTHYGMNWVKQAPGKGLKWMGWINTYTGEPTYADDFKGRFAFSLETSASTAYLQINNLKNEDTAT
YFCARDYYGSSPYWGQGTTLTVSS/ASTKGPSVFPLAPSSKSTSGGTAALGCLVKDYFPEPVTVSWNSGALTSGVHTFPAVLQSSGLYSLSSV
VTVPSSSLGTQTYICNVNHKPSNTKVDKKVEPKSCDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREEMTKNQVSLTCLVKGF
YPSDIAVEWESNGQPENNYKTTPPVLDSDGSFFLYSKLTVDKSRWQQGNVFSCSVMHEALHNHYTQKSLSLSPGK

XENP021575 1C11[PD-1]_H0L0_IgG1_PVA_/S267K Light Chain (SEQ ID NOS 39229-39233)
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYC
FQGSHVPNTFGGGTKLEIK/RTVAAPSVFIFPPSDEQLKSGTASVVCLLNNFYPREAKVQWKVDNALQSGNSQESVTEQDSKDSTYSLSSTLT
LSKADYEKHKVYACEVTHQGLSSPVTKSFNRGEC

FIG. 10

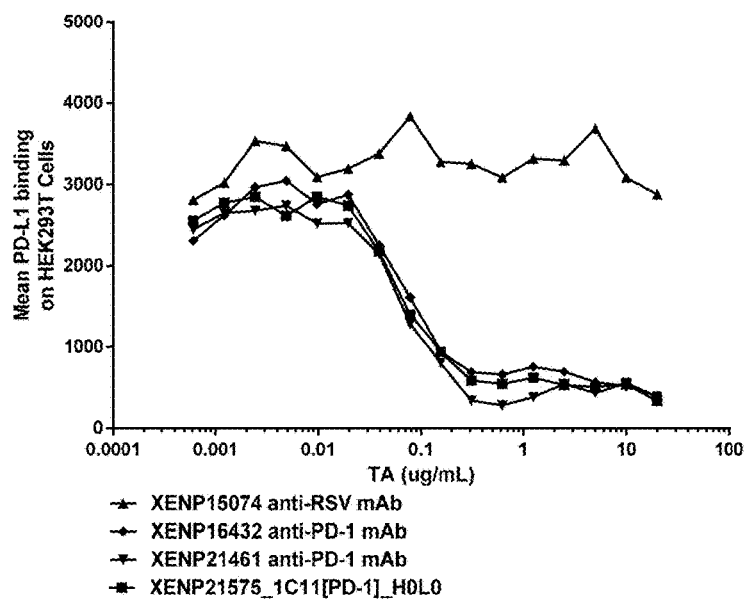

FIG. 13A

>XENP022543 1C11[PD-1]_H1L1_IgG1_PVA_/S267K Heavy Chain (SEQ ID NOS 39234-39238)
QIQLVQSGAEVKKPGASVKVSCKASGYTFTHYGMNWVRQAPGQGLEWMGWINTYTGEPTYADKFQGRVTMTLDTSTS
TAYMELSSLRSEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP022543 1C11[PD-1]_H1L1_IgG1_PVA_/S267K Light Chain (SEQ ID NOS 39239-39243)
DVLMTQSPLSLPVTPGEPASISCRSSQSIVHSNGNTYLEWYLQKPGQSPQLLIYKVSNRFSGVPDRFSGSGSGTDFT
LKISRVEAEDVGVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP022544 1C11[PD-1]_H2L1_IgG1_PVA_/S267K Heavy Chain (SEQ ID NOS 39244-39248)
EIQLLESGGGLVQPGGSLRLSCAASGYTFTHYGMNWVRQAPGKGLEWVSWINTYTGEPTYADSVKGRFTISLDTSKS
TAYLQMNSLRAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP022544 1C11[PD-1]_H2L1_IgG1_PVA_/S267K Light Chain (SEQ ID NOS 39249-39253)
DVLMTQSPLSLPVTPGEPASISCRSSQSIVHSNGNTYLEWYLQKPGQSPQLLIYKVSNRFSGVPDRFSGSGSGTDFT
LKISRVEAEDVGVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP022545 1C11[PD-1]_H3L1_IgG1_PVA_/S267K Heavy Chain (SEQ ID NOS 39254-39258)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP022545 1C11[PD-1]_H3L1_IgG1_PVA_/S267K Light Chain (SEQ ID NOS 39259-39263)
DVLMTQSPLSLPVTPGEPASISCRSSQSIVHSNGNTYLEWYLQKPGQSPQLLIYKVSNRFSGVPDRFSGSGSGTDFT
LKISRVEAEDVGVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP022546 1C11[PD-1]_H4L1_IgG1_PVA_/S267K Heavy Chain (SEQ ID NOS 39264-39268)
EVQLLESGGGLVQPGGSLRLSCAASGYTFTHYGMNWVRQAPGKGLEWVSWINTYTGEPTYADSVKGRFTISLDTSKS
TAYLQMNSLRAEDTAVYYCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP022546 1C11[PD-1]_H4L1_IgG1_PVA_/S267K Light Chain (SEQ ID NOS 39269-39273)
DVLMTQSPLSLPVTPGEPASISCRSSQSIVHSNGNTYLEWYLQKPGQSPQLLIYKVSNRFSGVPDRFSGSGSGTDFT
LKISRVEAEDVGVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

FIG. 13B

>XENP022547 1C11[PD-1]_H1L2_IgG1_PVA_/S267K Heavy Chain (SEQ ID NOS 39274-39278)
QIQLVQSGAEVKKPGASVKVSCKASGYTFTHYGMNWVRQAPGQGLEWMGWINTYTGEPTYADKFQGRVTMTLDTSTS
TAYMELSSLRSEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP022547 1C11[PD-1]_H1L2_IgG1_PVA_/S267K Light Chain (SEQ ID NOS 39279-39283)
DVLMTQSPLSLPVTLGQPASISCRSSQSIVHSNGNTYLEWYQQRPGQSPRLLIYKVSNRFSGVPDRFSGSGSGTDFT
LKISRVEAEDVGVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP022548 1C11[PD-1]_H2L2_IgG1_PVA_/S267K Heavy Chain (SEQ ID NOS 39284-39288)
EIQLLESGGGLVQPGGSLRLSCAASGYTFTHYGMNWVRQAPGKGLEWVSWINTYTGEPTYADSVKGRFTISLDTSKS
TAYLQMNSLRAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP022548 1C11[PD-1]_H2L2_IgG1_PVA_/S267K Light Chain (SEQ ID NOS 39289-39293)
DVLMTQSPLSLPVTLGQPASISCRSSQSIVHSNGNTYLEWYQQRPGQSPRLLIYKVSNRFSGVPDRFSGSGSGTDFT
LKISRVEAEDVGVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP022549 1C11[PD-1]_H3L2_IgG1_PVA_/S267K Heavy Chain (SEQ ID NOS 39294-39298)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP022549 1C11[PD-1]_H3L2_IgG1_PVA_/S267K Light Chain (SEQ ID NOS 39299-39303)
DVLMTQSPLSLPVTLGQPASISCRSSQSIVHSNGNTYLEWYQQRPGQSPRLLIYKVSNRFSGVPDRFSGSGSGTDFT
LKISRVEAEDVGVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP022550 1C11[PD-1]_H4L2_IgG1_PVA_/S267K Heavy Chain (SEQ ID NOS 39304-39308)
EVQLLESGGGLVQPGGSLRLSCAASGYTFTHYGMNWVRQAPGKGLEWVSWINTYTGEPTYADSVKGRFTISLDTSKS
TAYLQMNSLRAEDTAVYYCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP022550 1C11[PD-1]_H4L2_IgG1_PVA_/S267K Light Chain (SEQ ID NOS 39309-39313)
DVLMTQSPLSLPVTLGQPASISCRSSQSIVHSNGNTYLEWYQQRPGQSPRLLIYKVSNRFSGVPDRFSGSGSGTDFT
LKISRVEAEDVGVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

FIG. 13C

>XENP022551 1C11[PD-1]_H1L3_IgG1_PVA_/S267K Heavy Chain (SEQ ID NOS 39314-39318)
QIQLVQSGAEVKKPGASVKVSCKASGYTFTHYGMNWVRQAPGQGLEWMGWINTYTGEPTYADKFQGRVTMTLDTSTS
TAYMELSSLRSEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP022551 1C11[PD-1]_H1L3_IgG1_PVA_/S267K Light Chain (SEQ ID NOS 39319-39323)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP022552 1C11[PD-1]_H2L3_IgG1_PVA_/S267K Heavy Chain (SEQ ID NOS 39324-39328)
EIQLLESGGGLVQPGGSLRLSCAASGYTFTHYGMNWVRQAPGKGLEWVSWINTYTGEPTYADSVKGRFTISLDTSKS
TAYLQMNSLRAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP022552 1C11[PD-1]_H2L3_IgG1_PVA_/S267K Light Chain (SEQ ID NOS 39329-39333)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP022553 1C11[PD-1]_H3L3_IgG1_PVA_/S267K Heavy Chain (SEQ ID NOS 39334-39338)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP022553 1C11[PD-1]_H3L3_IgG1_PVA_/S267K Light Chain (SEQ ID NOS 39339-39343)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP022554 1C11[PD-1]_H4L3_IgG1_PVA_/S267K Heavy Chain (SEQ ID NOS 39344-39348)
EVQLLESGGGLVQPGGSLRLSCAASGYTFTHYGMNWVRQAPGKGLEWVSWINTYTGEPTYADSVKGRFTISLDTSKS
TAYLQMNSLRAEDTAVYYCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP022554 1C11[PD-1]_H4L3_IgG1_PVA_/S267K Light Chain (SEQ ID NOS 39349-39353)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

FIG. 15A

>XENP022538 1C11[PD-1]_H3L3_scFv(GKPGS)4 (SEQ ID NOS 39354-39362 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK >XENP023577 1C11_H3_L3.1_scFv(GKPGS)4 (SEQ ID NOS 39363-39371 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/GKPGSGKPGSGKPGSGKPGS/DILMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK >XENP023579 1C11_H3_L3.3_scFv(GKPGS)4 (SEQ ID NOS 39372-39380 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/GKPGSGKPGSGKPGSGKPGS/DVVMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK >XENP023589 1C11_H3_L3.15_scFv(GKPGS)4 (SEQ ID NOS 39381-39389 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/GKPGSGKPGSGKPGSGKPGS/DVLMTQSPDSLSVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK >XENP023601 1C11_H3_L3.23_scFv(GKPGS)4 (SEQ ID NOS 39390-39398 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/GKPGSGKPGSGKPGSGKPGS/DVLMTQSPDSLAVSLGERVTINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK >XENP023605 1C11_H3_L3.28_scFv(GKPGS)4 (SEQ ID NOS 39399-39407 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/GKPGSGKPGSGKPGSGKPGS/DVLMTQSPDSLAVSLGERATINCRS
SQSIVHSNGNTYLEWYQQKPGQSPKLLIYKVSNRFSGVPDRFSGSGSGTDFTLTISSLQAEDVAVYYCFQGSHVPNTFGGGT
KVEIK >XENP023609 1C11_H3_L3.32_scFv(GKPGS)4 (SEQ ID NOS 39408-39416 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/GKPGSGKPGSGKPGSGKPGS/DVLMTQSPDSLAVSLGERATINCKA
SQSIVHSNGNTYLEWYQQKPGQSPKLLIYKVSNRFSGVPDRFSGSGSGTDFTLTISSLQAEDVAVYYCFQGSHVPNTFGGGT
KVEIK >XENP023615 1C11_H3_L3.46_scFv(GKPGS)4 (SEQ ID NOS 39417-39425 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/GKPGSGKPGSGKPGSGKPGS/DVLMTQSPDSLAVSLGERATINCKS
SQSIVHSNGNTYLEWYQQKPGQPPKLLIYKVSNRFSGVPDRFSGSGSGTDFTLTISSLQAEDVAVYYCFQGSHVPNTFGGGT
KVEIK >XENP023616 1C11_H3_L3.47_scFv(GKPGS)4 (SEQ ID NOS 39426-39434 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/GKPGSGKPGSGKPGSGKPGS/DVLMTQSPDSLAVSLGERATINCKS
SQSIVHSNGNTYLEWYQQKPGQAPKLLIYKVSNRFSGVPDRFSGSGSGTDFTLTISSLQAEDVAVYYCFQGSHVPNTFGGGT
KVEIK

FIG. 15B

>XENP023624 1C11_H3_L3.57_scFv(GKPGS)4 (SEQ ID NOS 39435-39443 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/GKPGSGKPGSGKPGSGKPGS/DVLMTQSPDSLAVSL
GERATINCKSSQSIVHSNGNTYLEWYQQKPGQSPKLLIYKVSNRFTGVPDRFSGSGSGTDFTLTISSLQAEDVAVYY
CFQGSHVPNTFGGGTKVEIK

>XENP023626 1C11_H3_L3.59_scFv(GKPGS)4 (SEQ ID NOS 39444-39452 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/GKPGSGKPGSGKPGSGKPGS/DVLMTQSPDSLAVSL
GERATINCKSSQSIVHSNGNTYLEWYQQKPGQSPKLLIYKVSNRFSGVPDRFSGSGSGTDFTLTISRLQAEDVAVYY
CFQGSHVPNTFGGGTKVEIK

>XENP023628 1C11_H3_L3.62_scFv(GKPGS)4 (SEQ ID NOS 39453-39461 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/GKPGSGKPGSGKPGSGKPGS/DVLMTQSPDSLAVSL
GERATINCKSSQSIVHSNGNTYLEWYQQKPGQSPKLLIYKVSNRFSGVPDRFSGSGSGTDFTLTISSMQAEDVAVYY
CFQGSHVPNTFGGGTKVEIK

>XENP023629 1C11_H3_L3.63_scFv(GKPGS)4 (SEQ ID NOS 39462-39470 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/GKPGSGKPGSGKPGSGKPGS/DVLMTQSPDSLAVSL
GERATINCKSSQSIVHSNGNTYLEWYQQKPGQSPKLLIYKVSNRFSGVPDRFSGSGSGTDFTLTISSVQAEDVAVYY
CFQGSHVPNTFGGGTKVEIK

>XENP023633 1C11_H3_L3.69_scFv(GKPGS)4 (SEQ ID NOS 39471-39479 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/GKPGSGKPGSGKPGSGKPGS/DVLMTQSPDSLAVSL
GERATINCKSSQSIVHSNGNTYLEWYQQKPGQSPKLLIYKVSNRFSGVPDRFSGSGSGTDFTLTISSLQAEDAAVYY
CFQGSHVPNTFGGGTKVEIK

>XENP023636 1C11_H3_L3.73_scFv(GKPGS)4 (SEQ ID NOS 39480-39488 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/GKPGSGKPGSGKPGSGKPGS/DVLMTQSPDSLAVSL
GERATINCKSSQSIVHSNGNTYLEWYQQKPGQSPKLLIYKVSNRFSGVPDRFSGSGSGTDFTLTISSLQAEDVATYY
CFQGSHVPNTFGGGTKVEIK

>XENP023640 1C11_H3_L3.81_scFv(GKPGS)4 (SEQ ID NOS 39489-39497 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/GKPGSGKPGSGKPGSGKPGS/DVLMTQSPDSLAVSL
GERATINCKSSQSIVHSNGNTYLEWYQQKPGQSPKLLIYKVSNRFSGVPDRFSGSGSGTDFTLTISSLQAEDVAVYY
CFQGSHVPNTFGGQTKVEIK

>XENP023755 1C11_H3.1_L3_scFv(GKPGS)4 (SEQ ID NOS 39498-39506 and linker disclosed as SEQ ID NO: 39202)
QVQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/GKPGSGKPGSGKPGSGKPGS/DVLMTQSPDSLAVSL
GERATINCKSSQSIVHSNGNTYLEWYQQKPGQSPKLLIYKVSNRFSGVPDRFSGSGSGTDFTLTISSLQAEDVAVYY
CFQGSHVPNTFGGGTKVEIK

FIG. 15C

>XENP023758 1C11_H3.5_L3_scFv(GKPGS)4 (SEQ ID NOS 39507-39515 and linker disclosed as SEQ ID NO: 39202)
QIQLVQSGAELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/GKPGSGKPGSGKPGSGKPGS/DVLMTQSPDSLAVSL
GERATINCKSSQSIVHSNGNTYLEWYQQKPGQSPKLLIYKVSNRFSGVPDRFSGSGSGTDFTLTISSLQAEDVAVYY
CFQGSHVPNTFGGGTKVEIK

>XENP023760 1C11_H3.7_L3_scFv(GKPGS)4 (SEQ ID NOS 39516-39524 and linker disclosed as SEQ ID NO: 39202)
QIQLVQSGPELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/GKPGSGKPGSGKPGSGKPGS/DVLMTQSPDSLAVSL
GERATINCKSSQSIVHSNGNTYLEWYQQKPGQSPKLLIYKVSNRFSGVPDRFSGSGSGTDFTLTISSLQAEDVAVYY
CFQGSHVPNTFGGGTKVEIK

>XENP023765 1C11_H3.18_L3_scFv(GKPGS)4 (SEQ ID NOS 39525-39533 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/GKPGSGKPGSGKPGSGKPGS/DVLMTQSPDSLAVSL
GERATINCKSSQSIVHSNGNTYLEWYQQKPGQSPKLLIYKVSNRFSGVPDRFSGSGSGTDFTLTISSLQAEDVAVYY
CFQGSHVPNTFGGGTKVEIK

>XENP023770 1C11_H3.25_L3_scFv(GKPGS)4 (SEQ ID NOS 39534-39542 and linker disclosed as SEQ ID NO: 39202)
QIQLVQSGSELKKPGASVKVSCKASGYTFTHYGMNWVRQAPGQGLEWMGWINTNTGEPTYADGFTGRFVFSLDTSVS
TAYLQISSLKAEDTAVYFCARDYYGSSPYWGQGTLVTVSS/GKPGSGKPGSGKPGSGKPGS/DVLMTQSPDSLAVSL
GERATINCKSSQSIVHSNGNTYLEWYQQKPGQSPKLLIYKVSNRFSGVPDRFSGSGSGTDFTLTISSLQAEDVAVYY
CFQGSHVPNTFGGGTKVEIK

>XENP023776 1C11_H3.35_L3_scFv(GKPGS)4 (SEQ ID NOS 39543-39551 and linker disclosed as SEQ ID NO: 39202)
QIQLVQSGSELKKPGASVKVSCKASGYTFTHYGMNWVRQAPGQGLEWMGWINTYTGEPTYADKFTGRFVFSLDTSVS
TAYLQISSLKAEDTAVYFCARDYYGSSPYWGQGTLVTVSS/GKPGSGKPGSGKPGSGKPGS/DVLMTQSPDSLAVSL
GERATINCKSSQSIVHSNGNTYLEWYQQKPGQSPKLLIYKVSNRFSGVPDRFSGSGSGTDFTLTISSLQAEDVAVYY
CFQGSHVPNTFGGGTKVEIK

>XENP023779 1C11_H3.41_L3_scFv(GKPGS)4 (SEQ ID NOS 39552-39560 and linker disclosed as SEQ ID NO: 39202)
QIQLVQSGSELKKPGASVKVSCKASGYTFTHYGMNWVRQAPGQGLEWMGWINTYTGEPTYADGFKGRFVFSLDTSVS
TAYLQISSLKAEDTAVYFCARDYYGSSPYWGQGTLVTVSS/GKPGSGKPGSGKPGSGKPGS/DVLMTQSPDSLAVSL
GERATINCKSSQSIVHSNGNTYLEWYQQKPGQSPKLLIYKVSNRFSGVPDRFSGSGSGTDFTLTISSLQAEDVAVYY
CFQGSHVPNTFGGGTKVEIK

>XENP023780 1C11_H3.42_L3_scFv(GKPGS)4 (SEQ ID NOS 39561-39569 and linker disclosed as SEQ ID NO: 39202)
QIQLVQSGSELKKPGASVKVSCKASGYTFTHYGMNWVRQAPGQGLEWMGWINTYTGEPTYADGFQGRFVFSLDTSVS
TAYLQISSLKAEDTAVYFCARDYYGSSPYWGQGTLVTVSS/GKPGSGKPGSGKPGSGKPGS/DVLMTQSPDSLAVSL
GERATINCKSSQSIVHSNGNTYLEWYQQKPGQSPKLLIYKVSNRFSGVPDRFSGSGSGTDFTLTISSLQAEDVAVYY
CFQGSHVPNTFGGGTKVEIK

>XENP023781 1C11_H3.43_L3_scFv(GKPGS)4 (SEQ ID NOS 39570-39578 and linker disclosed as SEQ ID NO: 39202)
QIQLVQSGSELKKPGASVKVSCKASGYTFTHYGMNWVRQAPGQGLEWMGWINTYTGEPTYADGFTGRVVFSLDTSVS
TAYLQISSLKAEDTAVYFCARDYYGSSPYWGQGTLVTVSS/GKPGSGKPGSGKPGSGKPGS/DVLMTQSPDSLAVSL
GERATINCKSSQSIVHSNGNTYLEWYQQKPGQSPKLLIYKVSNRFSGVPDRFSGSGSGTDFTLTISSLQAEDVAVYY
CFQGSHVPNTFGGGTKVEIK

>XENP023786 1C11_H3.50_L3_scFv(GKPGS)4 (SEQ ID NOS 39579-39587 and linker disclosed as SEQ ID NO: 39202)
QIQLVQSGSELKKPGASVKVSCKASGYTFTHYGMNWVRQAPGQGLEWMGWINTYTGEPTYADGFTGRVFSADTSVS
TAYLQISSLKAEDTAVYFCARDYYGSSPYWGQGTLVTVSS/GKPGSGKPGSGKPGSGKPGS/DVLMTQSPDSLAVSL
GERATINCKSSQSIVHSNGNTYLEWYQQKPGQSPKLLIYKVSNRFSGVPDRFSGSGSGTDFTLTISSLQAEDVAVYY
CFQGSHVPNTFGGGTKVEIK

FIG. 15D

>XENP023793 1C11_H3.59_L3_scFv(GKPGS)4 (SEQ ID NOS 39588-39596 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSQSTAYLQ
ISSLKAEDTAVYFCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK

>XENP023796 1C11_H3.62_L3_scFv(GKPGS)4 (SEQ ID NOS 39597-39605 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSVSTIYLQ
ISSLKAEDTAVYFCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK

>XENP023811 1C11_H3.74_L3_scFv(GKPGS)4 (SEQ ID NOS 39606-39614 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYYCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK

>XENP024201 1C11_H3_L3.113_scFv(GKPGS)4 (SEQ ID NOS 39615-39623 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/GKPGSGKPGSGKPGSGKPGS/DVLMTQSPDSLAVSLGERATINCKS
SQSIVHSNGNTYLEWYQQKPGKSPKLLIYKVSNRFSGVPDRFSGSGSGTDFTLTISSLQAEDVAVYYCFQGSHVPNTFGGGT
KVEIK

>XENP024207 1C11_H3_L3.122_scFv(GKPGS)4 (SEQ ID NOS 39624-39632 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGIPDRFSGSGSGTDFTLTISSLQAEDVAVYYCFQGSHVPNTFGGGT
KVEIK

>XENP024208 1C11_H3_L3.124_scFv(GKPGS)4 (SEQ ID NOS 39633-39641 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPARFSGSGSGTDFTLTISSLQAEDVAVYYCFQGSHVPNTFGGGT
KVEIK

>XENP024209 1C11_H3_L3.125_scFv(GKPGS)4 (SEQ ID NOS 39642-39650 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSVEAEDVAVYYCFQGSHVPNTFGGGT
KVEIK

>XENP024210 1C11_H3_L3.132_scFv(GKPGS)4 (SEQ ID NOS 39651-39659 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGPGT
KVEIK

>XENP024211 1C11_H3.78_L3_scFv(GKPGS)4 (SEQ ID NOS 39660-39668 and linker disclosed as SEQ ID NO: 39202)
QIQLVQSGPELKKPGASVKVSCKASGYTFTHYGMNWVRQAPGQGLEWMGWINTNTGEPTYADGFTGRFVFSVDTSQSTAYLQ
ISSLKAEDTAVYFCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK

FIG. 15E

>XENP024212 1C11_H3.80_L3_scFv(GKPGS)4 (SEQ ID NOS 39669-39677 and linker disclosed as SEQ ID NO: 39202)
QIQLVQSGSELKKPGASVKVSCKASGYTFTHYGMNWVRQAPGQGLEWMGWINTNTGEPTYADGFTGRFVFSVDTSQS
TAYLQISSLKAEDTAVYYCARDYYGSSPYWGQGTLVTVSS/GKPGSGKPGSGKPGSGKPGS/DVLMTQSPDSLAVSL
GERATINCKSSQSIVHSNGNTYLEWYQQKPGQSPKLLIYKVSNRFSGVPDRFSGSGSGTDFTLTISSLQAEDVAVYY
CFQGSHVPNTFGGGTKVEIK

>XENP024213 1C11_H3.81_L3_scFv(GKPGS)4 (SEQ ID NOS 39678-39686 and linker disclosed as SEQ ID NO: 39202)
QIQLVQSGSELKKPGASVKVSCKASGYTFTHYGMNWVRQAPGQGLEWMGWINTYTGEPTYADKFKGRFVFSLDTSVS
TAYLQISSLKAEDTAVYFCARDYYGSSPYWGQGTLVTVSS/GKPGSGKPGSGKPGSGKPGS/DVLMTQSPDSLAVSL
GERATINCKSSQSIVHSNGNTYLEWYQQKPGQSPKLLIYKVSNRFSGVPDRFSGSGSGTDFTLTISSLQAEDVAVYY
CFQGSHVPNTFGGGTKVEIK

>XENP024214 1C11_H3.82_L3_scFv(GKPGS)4 (SEQ ID NOS 39687-39695 and linker disclosed as SEQ ID NO: 39202)
QIQLVQSGSELKKPGASVKVSCKASGYTFTHYGMNWVRQAPGQGLEWMGWINTYTGEPTYADKFQGRFVFSLDTSVS
TAYLQISSLKAEDTAVYFCARDYYGSSPYWGQGTLVTVSS/GKPGSGKPGSGKPGSGKPGS/DVLMTQSPDSLAVSL
GERATINCKSSQSIVHSNGNTYLEWYQQKPGQSPKLLIYKVSNRFSGVPDRFSGSGSGTDFTLTISSLQAEDVAVYY
CFQGSHVPNTFGGGTKVEIK

>XENP024215 1C11_H3.83_L3_scFv(GKPGS)4 (SEQ ID NOS 39696-39704 and linker disclosed as SEQ ID NO: 39202)
QIQLVQSGSELKKPGASVKVSCKASGYTFTHYGMNWVRQAPGQGLEWMGWINTNTGEPTYADGFTGRFVFSVDTSQS
TAYLQISSLKAEDTAVYFCARDYYGSSPYWGQGTLVTVSS/GKPGSGKPGSGKPGSGKPGS/DVLMTQSPDSLAVSL
GERATINCKSSQSIVHSNGNTYLEWYQQKPGQSPKLLIYKVSNRFSGVPDRFSGSGSGTDFTLTISSLQAEDVAVYY
CFQGSHVPNTFGGGTKVEIK

>XENP024216 1C11_H3.84_L3_scFv(GKPGS)4 (SEQ ID NOS 39705-39713 and linker disclosed as SEQ ID NO: 39202)
QIQLVQSGSELKKPGASVKVSCKASGYTFTHYGMNWVRQAPGQGLEWMGWINTYTGEPTYADKFKGRFVFSLDTSQS
TAYLQISSLKAEDTAVYFCARDYYGSSPYWGQGTLVTVSS/GKPGSGKPGSGKPGSGKPGS/DVLMTQSPDSLAVSL
GERATINCKSSQSIVHSNGNTYLEWYQQKPGQSPKLLIYKVSNRFSGVPDRFSGSGSGTDFTLTISSLQAEDVAVYY
CFQGSHVPNTFGGGTKVEIK

>XENP024217 1C11_H3.85_L3_scFv(GKPGS)4 (SEQ ID NOS 39714-39722 and linker disclosed as SEQ ID NO: 39202)
QIQLVQSGSELKKPGASVKVSCKASGYTFTHYGMNWVRQAPGQGLEWMGWINTYTGEPTYADKFQGRFVFSLDTSQS
TAYLQISSLKAEDTAVYFCARDYYGSSPYWGQGTLVTVSS/GKPGSGKPGSGKPGSGKPGS/DVLMTQSPDSLAVSL
GERATINCKSSQSIVHSNGNTYLEWYQQKPGQSPKLLIYKVSNRFSGVPDRFSGSGSGTDFTLTISSLQAEDVAVYY
CFQGSHVPNTFGGGTKVEIK

>XENP024218 1C11_H3.86_L3_scFv(GKPGS)4 (SEQ ID NOS 39723-39731 and linker disclosed as SEQ ID NO: 39202)
EIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/GKPGSGKPGSGKPGSGKPGS/DVLMTQSPDSLAVSL
GERATINCKSSQSIVHSNGNTYLEWYQQKPGQSPKLLIYKVSNRFSGVPDRFSGSGSGTDFTLTISSLQAEDVAVYY
CFQGSHVPNTFGGGTKVEIK

>XENP024221 1C11_H3.90_L3_scFv(GKPGS)4 (SEQ ID NOS 39732-39740 and linker disclosed as SEQ ID NO: 39202)
QIQLVQSGSVLKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/GKPGSGKPGSGKPGSGKPGS/DVLMTQSPDSLAVSL
GERATINCKSSQSIVHSNGNTYLEWYQQKPGQSPKLLIYKVSNRFSGVPDRFSGSGSGTDFTLTISSLQAEDVAVYY
CFQGSHVPNTFGGGTKVEIK

>XENP024222 1C11_H3.91_L3_scFv(GKPGS)4 (SEQ ID NOS 39741-39749 and linker disclosed as SEQ ID NO: 39202)
QIQLVQSGSELVKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/GKPGSGKPGSGKPGSGKPGS/DVLMTQSPDSLAVSL
GERATINCKSSQSIVHSNGNTYLEWYQQKPGQSPKLLIYKVSNRFSGVPDRFSGSGSGTDFTLTISSLQAEDVAVYY
CFQGSHVPNTFGGGTKVEIK

FIG. 15F

>XENP024226 1C11_H3.95_L3_scFv(GKPGS)4 (SEQ ID NOS 39750-39758 and linker disclosed as SEQ ID NO: 39202)
QIQLVQSGSELKKPGGSVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK >XENP024227 1C11_H3.96_L3_scFv(GKPGS)4 (SEQ ID NOS 39759-39767 and linker disclosed as SEQ ID NO: 39202)
QIQLVQSGSELKKPGQSVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK >XENP024228 1C11_H3.97_L3_scFv(GKPGS)4 (SEQ ID NOS 39768-39776 and linker disclosed as SEQ ID NO: 39202)
QIQLVQSGSELKKPGESVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK >XENP024247 1C11_H3.120_L3_scFv(GKPGS)4 (SEQ ID NOS 39777-39785 and linker disclosed as SEQ ID NO: 39202)
QIQLVQSGSELKKPGASVKVSCKASGYTFTHYGINWVRQAPGQGLEWMGWINTYTGEPTYADGFTGRFVFSLDTSVSTAYLQ
ISSLKAEDTAVYFCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK >XENP024250 1C11_H3.125_L3_scFv(GKPGS)4 (SEQ ID NOS 39786-39794 and linker disclosed as SEQ ID NO: 39202)
QIQLVQSGSELKKPGASVKVSCKASGYTFTHYGMNWVRQPPGQGLEWMGWINTYTGEPTYADGFTGRFVFSLDTSVSTAYLQ
ISSLKAEDTAVYFCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK >XENP024254 1C11_H3.129_L3_scFv(GKPGS)4 (SEQ ID NOS 39795-39803 and linker disclosed as SEQ ID NO: 39202)
QIQLVQSGSELKKPGASVKVSCKASGYTFTHYGMNWVRQAPGQGLEWIGWINTYTGEPTYADGFTGRFVFSLDTSVSTAYLQ
ISSLKAEDTAVYFCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK >XENP024256 1C11_H3.134_L3_scFv(GKPGS)4 (SEQ ID NOS 39804-39812 and linker disclosed as SEQ ID NO: 39202)
QIQLVQSGSELKKPGASVKVSCKASGYTFTHYGMNWVRQAPGQGLEWMGWINTKTGEPTYADGFTGRFVFSLDTSVSTAYLQ
ISSLKAEDTAVYFCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK >XENP024263 1C11_H3.143_L3_scFv(GKPGS)4 (SEQ ID NOS 39813-39821 and linker disclosed as SEQ ID NO: 39202)
QIQLVQSGSELKKPGASVKVSCKASGYTFTHYGMNWVRQAPGQGLEWMGWINTYTGEPYYADGFTGRFVFSLDTSVSTAYLQ
ISSLKAEDTAVYFCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK >XENP024266 1C11_H3.146_L3_scFv(GKPGS)4 (SEQ ID NOS 39822-39830 and linker disclosed as SEQ ID NO: 39202)
QIQLVQSGSELKKPGASVKVSCKASGYTFTHYGMNWVRQAPGQGLEWMGWINTYTGEPTYAPGFTGRFVFSLDTSVSTAYLQ
ISSLKAEDTAVYFCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK

FIG. 15G

>XENP024267 1C11_H3.147_L3_scFv(GKPGS)4 (SEQ ID NOS 39831-39839 and linker disclosed as SEQ ID NO: 39202)
QIQLVQSGSELKKPGASVKVSCKASGYTFTHYGMNWVRQAPGQGLEWMGWINTYTGEPTYATGFTGRFVFSLDTSVSTAYLQ
ISSLKAEDTAVYFCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK

>XENP024268 1C11_H3.148_L3_scFv(GKPGS)4 (SEQ ID NOS 39840-39848 and linker disclosed as SEQ ID NO: 39202)
QIQLVQSGSELKKPGASVKVSCKASGYTFTHYGMNWVRQAPGQGLEWMGWINTYTGEPTYAQKFTGRFVFSLDTSVSTAYLQ
ISSLKAEDTAVYFCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK

>XENP024270 1C11_H3.150_L3_scFv(GKPGS)4 (SEQ ID NOS 39849-39857 and linker disclosed as SEQ ID NO: 39202)
QIQLVQSGSELKKPGASVKVSCKASGYTFTHYGMNWVRQAPGQGLEWMGWINTYTGEPTYADGFTERFVFSLDTSVSTAYLQ
ISSLKAEDTAVYFCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK

>XENP024274 1C11_H3.154_L3_scFv(GKPGS)4 (SEQ ID NOS 39858-39866 and linker disclosed as SEQ ID NO: 39202)
QIQLVQSGSELKKPGASVKVSCKASGYTFTHYGMNWVRQAPGQGLEWMGWINTYTGEPTYADGFTGRFVFSIDTSVSTAYLQ
ISSLKAEDTAVYFCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK

>XENP024278 1C11_H3.158_L3_scFv(GKPGS)4 (SEQ ID NOS 39867-39875 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSVNTAYLQ
ISSLKAEDTAVYFCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK

>XENP024279 1C11_H3.159_L3_scFv(GKPGS)4 (SEQ ID NOS 39876-39884 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSVDTAYLQ
ISSLKAEDTAVYFCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK

>XENP024287 1C11_H3.168_L3_scFv(GKPGS)4 (SEQ ID NOS 39885-39893 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSVSTAYLQ
INSLKAEDTAVYFCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK

>XENP024291 1C11_H3.172_L3_scFv(GKPGS)4 (SEQ ID NOS 39894-39902 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSVSTAYLQ
ISSLKPEDTAVYFCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK

>XENP024372 1C11_H3_L3.86_scFv(GKPGS)4 (SEQ ID NOS 39903-39911 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFTGVPDRFSGSGSGTDFTLTISSVQAEDVATYYCFQGSHVPNTFGQGT
KVEIK

FIG. 15H

>XENP024373 1C11_H3_L3.87_scFv(GKPGS)4 (SEQ ID NOS 39912-39920 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/GKPGSGKPGSGKPGSGKPGS/DVVMTQSPDSLAVSLGERVTINCKA
SQSIVHSNGNTYLEWYQQKPGQPPKLLIYKVSNRFSGVPDRFSGSGSGTDFTLTISSLQAEDVAVYYCFQGSHVPNTFGGGT
KVEIK >XENP024374 1C11_H3_L3.90_scFv(GKPGS)4 (SEQ ID NOS 39921-39929 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/GKPGSGKPGSGKPGSGKPGS/DVVMTQSPDSLAVSLGERATINCKA
SQSIVHSNGNTYLEWYQQKPGQPPKLLIYKVSNRFSGVPDRFSGSGSGTDFTLTISSVQAEDAATYYCFQGSHVPNTFGQGT
KVEIK >XENP024375 1C11_H3_L3.92_scFv(GKPGS)4 (SEQ ID NOS 39930-39938 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/GKPGSGKPGSGKPGSGKPGS/DIVMTQSPDSLAVSLGERVTINCKA
SQSIVHSNGNTYLEWYQQKPGQPPKLLIYKVSNRFTGVPDRFSGSGSGTDFTLTISSLQAEDVAVYYCFQGSHVPNTFGGGT
KVEIK >XENP024376 1C11_H3_L3.94_scFv(GKPGS)4 (SEQ ID NOS 39939-39947 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/GKPGSGKPGSGKPGSGKPGS/DILMTQSPDSLAVSLGERATINCKS
SQSIVHSNGNTYLEWYQQKPGQSPKLLIYKVSNRFTGVPDRFSGSGSGTDFTLTISSVQAEDAATYYCFQGSHVPNTFGQGT
KVEIK >XENP024377 1C11_H3_L3.96_scFv(GKPGS)4 (SEQ ID NOS 39948-39956 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/GKPGSGKPGSGKPGSGKPGS/DIVMTQSPDSLAVSLGERATINCKA
SQSIVHSNGNTYLEWYQQKPGQPPKLLIYKVSNRFTGVPDRFSGSGSGTDFTLTISSVQAEDAATYYCFQGSHVPNTFGQGT
KVEIK >XENP024378 1C11_H3_L3.105_scFv(GKPGS)4 (SEQ ID NOS 39957-39965 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/GKPGSGKPGSGKPGSGKPGS/DVLMTQSPDSLPVTPGEPATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK >XENP024379 1C11_H3_L3.129_scFv(GKPGS)4 (SEQ ID NOS 39966-39974 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTINSLQAEDAATYYCHQGSHVPNTFGGGT
KVEIK >XENP024380 1C11_H3.176_L3.92_scFv(GKPGS)4 (SEQ ID NOS 39975-39983 and linker disclosed as SEQ ID NO: 39202)
QIQLVQSGPELKKPGASVKVSCKASGYTFTHYGMNWVRQAPGQGLEWMGWINTNTGEPTYADKFTGRVVFSLDTSQSTIYLQ
ISSLKAEDTAVYYCARDYYGSSPYWGQGTLVTVSS/GKPGSGKPGSGKPGSGKPGS/DIVMTQSPDSLAVSLGERVTINCKA
SQSIVHSNGNTYLEWYQQKPGQPPKLLIYKVSNRFTGVPDRFSGSGSGTDFTLTISSLQAEDVAVYYCFQGSHVPNTFGGGT
KVEIK >XENP024381 1C11_H3.176_L3.94_scFv(GKPGS)4 (SEQ ID NOS 39984-39992 and linker disclosed as SEQ ID NO: 39202)
QIQLVQSGPELKKPGASVKVSCKASGYTFTHYGMNWVRQAPGQGLEWMGWINTNTGEPTYADKFTGRVVFSLDTSQSTIYLQ
ISSLKAEDTAVYYCARDYYGSSPYWGQGTLVTVSS/GKPGSGKPGSGKPGSGKPGS/DILMTQSPDSLAVSLGERATINCKS
SQSIVHSNGNTYLEWYQQKPGQSPKLLIYKVSNRFTGVPDRFSGSGSGTDFTLTISSVQAEDAATYYCFQGSHVPNTFGQGT
KVEIK

FIG. 15I

>XENP024382 1C11_H3.176_L3.96_scFv(GKPGS)4 (SEQ ID NOS 39993-40001 and linker disclosed as SEQ ID NO: 39202)
QIQLVQSGPELKKPGASVKVSCKASGYTFTHYGMNWVKQAPGQGLEWMGWINTNTGEPTYADKFTGRVVFSLDTSQSTIYLQISSL
KAEDTAVYFCARDYYGSSPYWGQGTLVTVSS/GKPGSGKPGSGKPGSGKPGS/DIVMTQSPDSLAVSLGERATINCKASQSIVHSN
GNTYLEWYQQKPGQPPKLLIYKVSNRFTGVPDRFSGSGSGTDFTLTISSVQAEDAATYYCFQGSHVPNTFGQGTKVEIK

>XENP024414 1C11[PD-1]_H3_L3.133_scFv(GKPGS)4 (SEQ ID NOS 40002-40010 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSVSTAYLQISSL
KAEDTAVYFCARDYYGSSPYWGQGTLVTVSS/GKPGSGKPGSGKPGSGKPGS/DVVMTQSPDSLAVSLGERVTINCKASQSIVHSN
GNTYLEWYQQKPGQPPKLLIYKVSNRFSGVPDRFSGSGSGTDFTLTISSVQAEDAATYYCFQGSHVPNTFGQGTKVEIK

>XENP024415 1C11[PD-1]_H3_L3.134_scFv(GKPGS)4 (SEQ ID NOS 40011-40019 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSVSTAYLQISSL
KAEDTAVYFCARDYYGSSPYWGQGTLVTVSS/GKPGSGKPGSGKPGSGKPGS/DVVMTQSPDSLAVSLGERVTINCKASQSIVHSN
GNTYLEWYQQKPGQPPKLLIYKVSNRFSGVPDRFSGSGSGTDFTLTISSVEAEDAATYYCFQGSHVPNTFGQGTKVEIK

>XENP024416 1C11[PD-1]_H3_L3.135_scFv(GKPGS)4 (SEQ ID NOS 40020-40028 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSVSTAYLQISSL
KAEDTAVYFCARDYYGSSPYWGQGTLVTVSS/GKPGSGKPGSGKPGSGKPGS/DVVMTQSPDSLAVSLGERVTINCKASQSIVHSN
GNTYLEWYQQKPGQPPKLLIYKVSNRFSGVPDRFSGSGSGTDFTLTISSMQAEDAATYYCFQGSHVPNTFGQGTKVEIK

>XENP024417 1C11[PD-1]_H3_L3.136_scFv(GKPGS)4 (SEQ ID NOS 40029-40037 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSVSTAYLQISSL
KAEDTAVYFCARDYYGSSPYWGQGTLVTVSS/GKPGSGKPGSGKPGSGKPGS/DVVMTQSPDSLAVSLGERITINCKASQSIVHSN
GNTYLEWYQQKPGQPPKLLIYKVSNRFSGVPDRFSGSGSGTDFTLTISSMQAEDAATYYCFQGSHVPNTFGQGTKVEIK

>XENP024418 1C11[PD-1]_H3_L3.137_scFv(GKPGS)4 (SEQ ID NOS 40038-40046 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSVSTAYLQISSL
KAEDTAVYFCARDYYGSSPYWGQGTLVTVSS/GKPGSGKPGSGKPGSGKPGS/DVVMTQSPDSLAVSLGERITINCKASQSIVHSN
GNTYLEWYQQKPGQPPKLLIYKVSNRFSGVPDRFSGSGSGTDFTLTISSVQAEDAATYYCFQGSHVPNTFGQGTKVEIK

>XENP024419 1C11[PD-1]_H3_L3.138_scFv(GKPGS)4 (SEQ ID NOS 40047-40055 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSVSTAYLQISSL
KAEDTAVYFCARDYYGSSPYWGQGTLVTVSS/GKPGSGKPGSGKPGSGKPGS/DVVMTQSPDSLAVSLGERITINCKASQSIVHSN
GNTYLEWYQQKPGQPPKLLIYKVSNRFSGVPDRFSGSGSGTDFTLTISSVEAEDAATYYCFQGSHVPNTFGQGTKVEIK

>XENP024420 1C11[PD-1]_H3_L3.139_scFv(GKPGS)4 (SEQ ID NOS 40056-40064 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSVSTAYLQISSL
KAEDTAVYFCARDYYGSSPYWGQGTLVTVSS/GKPGSGKPGSGKPGSGKPGS/DVVMTQSPDSLAVSLGERATINCKASQSIVHSN
GNTYLEWYQQKPGQPPKLLIYKVSNRFSGIPDRFSGSGSGTDFTLTISSVQAEDAATYYCFQGSHVPNTFGQGTKVEIK

>XENP024421 1C11[PD-1]_H3_L3.140_scFv(GKPGS)4 (SEQ ID NOS 40065-40073 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSVSTAYLQISSL
KAEDTAVYFCARDYYGSSPYWGQGTLVTVSS/GKPGSGKPGSGKPGSGKPGS/DIVMTQSPDSLAVSLGERATINCKASQSIVHSN
GNTYLEWYQQKPGQSPKLLIYKVSNRFSGVPDRFSGSGSGTDFTLTISSVEAEDVATYYCFQGSHVPNTFGQGTKVEIK

FIG. 15J

>XENP024422 1C11[PD-1]_H3_L3.141_scFv(GKPGS)4 (SEQ ID NOS 40074-40082 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSVSTAYLQISSL
KAEDTAVYFCARDYYGSSPYWGQGTLVTVSS/GKPGSGKPGSGKPGSGKPGS/DIVMTQSPDSLAVSLGERATINCKASQSIVHSN
GNTYLEWYQQKPGQPPKLLIYKVSNRFSGVPDRFSGSGSGTDFTLTISSVEAEDVATYYCFQGSHVPNTFGQGTKVEIK

>XENP024423 1C11[PD-1]_H3_L3.142_scFv(GKPGS)4 (SEQ ID NOS 40083-40091 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSVSTAYLQISSL
KAEDTAVYFCARDYYGSSPYWGQGTLVTVSS/GKPGSGKPGSGKPGSGKPGS/DIVMTQSPDSLAVSLGERATINCKASQSIVHSN
GNTYLEWYQQKPGQAPKLLIYKVSNRFSGVPDRFSGSGSGTDFTLTISSVEAEDVATYYCFQGSHVPNTFGQGTKVEIK

>XENP024424 1C11[PD-1]_H3.176_L3_scFv(GKPGS)4 (SEQ ID NOS 40092-40100 and linker disclosed as SEQ ID NO: 39202)
QIQLVQSGSELKKPGASVKVSCKASGYTFTHYGMNWVRQAPGQGLEWMGWINTYTGEPTYAPGFKGRFVFSLDTSVSTAYLQISSL
KAEDTAVYFCARDYYGSSPYWGQGTLVTVSS/GKPGSGKPGSGKPGSGKPGS/DVLMTQSPDSLAVSLGERATINCKSSQSIVHSN
GNTYLEWYQQKPGQSPKLLIYKVSNRFSGVPDRFSGSGSGTDFTLTISSLQAEDVAVYYCFQGSHVPNTFGGGTKVEIK

>XENP024425 1C11[PD-1]_H3.177_L3_scFv(GKPGS)4 (SEQ ID NOS 40101-40109 and linker disclosed as SEQ ID NO: 39202)
QIQLVQSGSELKKPGASVKVSCKASGYTFTHYGMNWVRQAPGQGLEWMGWINTYTGEPTYAPKFTGRFVFSLDTSVSTAYLQISSL
KAEDTAVYFCARDYYGSSPYWGQGTLVTVSS/GKPGSGKPGSGKPGSGKPGS/DVLMTQSPDSLAVSLGERATINCKSSQSIVHSN
GNTYLEWYQQKPGQSPKLLIYKVSNRFSGVPDRFSGSGSGTDFTLTISSLQAEDVAVYYCFQGSHVPNTFGGGTKVEIK

>XENP024426 1C11[PD-1]_H3.178_L3_scFv(GKPGS)4 (SEQ ID NOS 40110-40118 and linker disclosed as SEQ ID NO: 39202)
QIQLVQSGSELKKPGASVKVSCKASGYTFTHYGMNWVRQAPGQGLEWMGWINTYTGEPTYAPKFKERFVFSLDTSVSTAYLQISSL
KAEDTAVYFCARDYYGSSPYWGQGTLVTVSS/GKPGSGKPGSGKPGSGKPGS/DVLMTQSPDSLAVSLGERATINCKSSQSIVHSN
GNTYLEWYQQKPGQSPKLLIYKVSNRFSGVPDRFSGSGSGTDFTLTISSLQAEDVAVYYCFQGSHVPNTFGGGTKVEIK

>XENP024427 1C11[PD-1]_H3.179_L3_scFv(GKPGS)4 (SEQ ID NOS 40119-40127 and linker disclosed as SEQ ID NO: 39202)
QIQLVQSGSELKKPGASVKVSCKASGYTFTHYGMNWVRQAPGQGLEWMGWINTYTGEPTYAPKFTERFVFSLDTSVSTAYLQISSL
KAEDTAVYFCARDYYGSSPYWGQGTLVTVSS/GKPGSGKPGSGKPGSGKPGS/DVLMTQSPDSLAVSLGERATINCKSSQSIVHSN
GNTYLEWYQQKPGQSPKLLIYKVSNRFSGVPDRFSGSGSGTDFTLTISSLQAEDVAVYYCFQGSHVPNTFGGGTKVEIK

>XENP024428 1C11[PD-1]_H3.180_L3_scFv(GKPGS)4 (SEQ ID NOS 40128-40136 and linker disclosed as SEQ ID NO: 39202)
QIQLVQSGSELKKPGASVKVSCKASGYTFTHYGINWVRQAPGQGLEWMGWINTYTGEPTYADGFTGRFVFSVDTSVSTAYLQISSL
KAEDTAVYFCARDYYGSSPYWGQGTLVTVSS/GKPGSGKPGSGKPGSGKPGS/DVLMTQSPDSLAVSLGERATINCKSSQSIVHSN
GNTYLEWYQQKPGQSPKLLIYKVSNRFSGVPDRFSGSGSGTDFTLTISSLQAEDVAVYYCFQGSHVPNTFGGGTKVEIK

>XENP024429 1C11[PD-1]_H3.181_L3_scFv(GKPGS)4 (SEQ ID NOS 40137-40145 and linker disclosed as SEQ ID NO: 39202)
QIQLVQSGSELKKPGASVKVSCKASGYTFTHYGINWVRQAPGQGLEWMGWINTYTGEPTYADGFTGRFVFSIDTSVSTAYLQISSL
KAEDTAVYFCARDYYGSSPYWGQGTLVTVSS/GKPGSGKPGSGKPGSGKPGS/DVLMTQSPDSLAVSLGERATINCKSSQSIVHSN
GNTYLEWYQQKPGQSPKLLIYKVSNRFSGVPDRFSGSGSGTDFTLTISSLQAEDVAVYYCFQGSHVPNTFGGGTKVEIK

>XENP024430 1C11[PD-1]_H3.182_L3_scFv(GKPGS)4 (SEQ ID NOS 40146-40154 and linker disclosed as SEQ ID NO: 39202)
QIQLVQSGSELVKPGESVKVSCKASGYTFTHYGMNWVRQAPGQGLEWMGWINTYTGEPTYADGFTGRFVFSLDTSVSTAYLQISSL
KAEDTAVYFCARDYYGSSPYWGQGTLVTVSS/GKPGSGKPGSGKPGSGKPGS/DVLMTQSPDSLAVSLGERATINCKSSQSIVHSN
GNTYLEWYQQKPGQSPKLLIYKVSNRFSGVPDRFSGSGSGTDFTLTISSLQAEDVAVYYCFQGSHVPNTFGGGTKVEIK

FIG. 15K

>XENP024431 1C11[PD-1]_H3.183_L3_scFv(GKPGS)4 (SEQ ID NOS 40155-40163 and linker disclosed as SEQ ID NO: 39202)
QIQLVQSGSVLKKPGESVKVSCKASGYTFTHYGMNWVRQAPGQGLEWMGWINTYTGEPTYADGFTGRFVFSLDTSVSTAYLQISSL
KAEDTAVYFCARDYYGSSPYWGQGTLVTVSS/GKPGSGKPGSGKPGSGKPGS/DVLMTQSPDSLAVSLGERATINCKSSQSIVHSN
GNTYLEWYQQKPGQSPKLLIYKVSNRFSGVPDRFSGSGSGTDFTLTISSLQAEDVAVYYCFQGSHVPNTFGGGTKVEIK >XENP024432 1C11[PD-1]_H3.184_L3_scFv(GKPGS)4 (SEQ ID NOS 40164-40172 and linker disclosed as SEQ ID NO: 39202)
QIQLVQSGSVLVKPGESVKVSCKASGYTFTHYGMNWVRQAPGQGLEWMGWINTYTGEPTYADGFTGRFVFSLDTSVSTAYLQISSL
KAEDTAVYFCARDYYGSSPYWGQGTLVTVSS/GKPGSGKPGSGKPGSGKPGS/DVLMTQSPDSLAVSLGERATINCKSSQSIVHSN
GNTYLEWYQQKPGQSPKLLIYKVSNRFSGVPDRFSGSGSGTDFTLTISSLQAEDVAVYYCFQGSHVPNTFGGGTKVEIK >XENP024433 1C11[PD-1]_H3.185_L3_scFv(GKPGS)4 (SEQ ID NOS 40173-40181 and linker disclosed as SEQ ID NO: 39202)
EVQLVQSGSELVKPGESVKVSCKASGYTFTHYGINWVRQPPGQGLEWIGWINTYTGEPYYAPKFTERFVFSLDTSQDTAYLQINSL
KAEDTAVYYCARDYYGSSPYWGQGTLVTVSS/GKPGSGKPGSGKPGSGKPGS/DVLMTQSPDSLAVSLGERATINCKSSQSIVHSN
GNTYLEWYQQKPGQSPKLLIYKVSNRFSGVPDRFSGSGSGTDFTLTISSLQAEDVAVYYCFQGSHVPNTFGGGTKVEIK >XENP024434 1C11[PD-1]_H3.186_L3_scFv(GKPGS)4 (SEQ ID NOS 40182-40190 and linker disclosed as SEQ ID NO: 39202)
EVQLVQSGSELVKPGESVKVSCKASGYTFTHYGINWVRQPPGQGLEWMGWINTYTGEPYYAPGFTERFVFSLDTSVDTAYLQINSL
KAEDTAVYYCARDYYGSSPYWGQGTLVTVSS/GKPGSGKPGSGKPGSGKPGS/DVLMTQSPDSLAVSLGERATINCKSSQSIVHSN
GNTYLEWYQQKPGQSPKLLIYKVSNRFSGVPDRFSGSGSGTDFTLTISSLQAEDVAVYYCFQGSHVPNTFGGGTKVEIK >XENP024435 1C11[PD-1]_H3.187_L3_scFv(GKPGS)4 (SEQ ID NOS 40191-40199 and linker disclosed as SEQ ID NO: 39202)
QVQLVQSGSELVKPGESVKVSCKASGYTFTHYGINWVRQPPGQGLEWMGWINTYTGEPYYAPGFTERFVFSLDTSQSTAYLQINSL
KAEDTAVYYCARDYYGSSPYWGQGTLVTVSS/GKPGSGKPGSGKPGSGKPGS/DVLMTQSPDSLAVSLGERATINCKSSQSIVHSN
GNTYLEWYQQKPGQSPKLLIYKVSNRFSGVPDRFSGSGSGTDFTLTISSLQAEDVAVYYCFQGSHVPNTFGGGTKVEIK >XENP024436 1C11[PD-1]_H3.188_L3_scFv(GKPGS)4 (SEQ ID NOS 40200-40208 and linker disclosed as SEQ ID NO: 39202)
QVQLVQSGSELKKPGESVKVSCKASGYTFTHYGINWVRQPPGQGLEWIGWINTYTGEPYYAPGFTGRFVFSLDTSQSTAYLQINSL
KAEDTAVYYCARDYYGSSPYWGQGTLVTVSS/GKPGSGKPGSGKPGSGKPGS/DVLMTQSPDSLAVSLGERATINCKSSQSIVHSN
GNTYLEWYQQKPGQSPKLLIYKVSNRFSGVPDRFSGSGSGTDFTLTISSLQAEDVAVYYCFQGSHVPNTFGGGTKVEIK >XENP024437 1C11[PD-1]_H3.189_L3_scFv(GKPGS)4 (SEQ ID NOS 40209-40217 and linker disclosed as SEQ ID NO: 39202)
QVQLVQSGSELKKPGASVKVSCKASGYTFTHYGINWVRQPPGQGLEWIGWINTYTGEPYYAPKFTGRFVFSLDTSVSTAYLQINSL
KAEDTAVYYCARDYYGSSPYWGQGTLVTVSS/GKPGSGKPGSGKPGSGKPGS/DVLMTQSPDSLAVSLGERATINCKSSQSIVHSN
GNTYLEWYQQKPGQSPKLLIYKVSNRFSGVPDRFSGSGSGTDFTLTISSLQAEDVAVYYCFQGSHVPNTFGGGTKVEIK >XENP024438 1C11[PD-1]_H3.190_L3_scFv(GKPGS)4 (SEQ ID NOS 40218-40226 and linker disclosed as SEQ ID NO: 39202)
QVQLVQSGSVLKKPGGSVKVSCKASGYTFTHYGINWVRQPPGQGLEWIGWINTYTGEPYYAPGFTGRFVFSLDTSQSTAYLQINSL
KAEDTAVYYCARDYYGSSPYWGQGTLVTVSS/GKPGSGKPGSGKPGSGKPGS/DVLMTQSPDSLAVSLGERATINCKSSQSIVHSN
GNTYLEWYQQKPGQSPKLLIYKVSNRFSGVPDRFSGSGSGTDFTLTISSLQAEDVAVYYCFQGSHVPNTFGGGTKVEIK >XENP024439 1C11[PD-1]_H3.191_L3_scFv(GKPGS)4 (SEQ ID NOS 40227-40235 and linker disclosed as SEQ ID NO: 39202)
QVQLVQSGSELVKPGESVKVSCKASGYTFTHYGMNWVRQAPGQGLEWMGWINTYTGEPTYAPGFTGRFVFSLDTSQSTAYLQINSL
KAEDTAVYFCARDYYGSSPYWGQGTLVTVSS/GKPGSGKPGSGKPGSGKPGS/DVLMTQSPDSLAVSLGERATINCKSSQSIVHSN
GNTYLEWYQQKPGQSPKLLIYKVSNRFSGVPDRFSGSGSGTDFTLTISSLQAEDVAVYYCFQGSHVPNTFGGGTKVEIK

FIG. 15L

>XENP024440 1C11[PD-1]_H3.192_L3_scFv(GKPGS)4 (SEQ ID NOS 40236-40244 and linker disclosed as SEQ ID NO: 39202)
EVQLVQSGSVLKKPGESVKVSCKASGYTFTHYGINWVRQAPGQGLEWMGWINTYTGEPTYADGFTERFVFSLDTSVSTAYLQISSL
KAEDTAVYFCARDYYGSSPYWGQGTLVTVSS/GKPGSGKPGSGKPGSGKPGS/DVLMTQSPDSLAVSLGERATINCKSSQSIVHSN
GNTYLEWYQQKPGQSPKLLIYKVSNRFSGVPDRFSGSGSGTDFTLTISSLQAEDVAVYYCFQGSHVPNTFGGGTKVEIK

>XENP024441 1C11[PD-1]_H3.193_L3_scFv(GKPGS)4 (SEQ ID NOS 40245-40253 and linker disclosed as SEQ ID NO: 39202)
QIQLVQSGSELKKPGASVKVSCKASGYTFTHYGMNWVRQPPGQGLEWIGWINTYTGEPTYAPGFTERFVFSLDTSQSTAYLQINSL
KAEDTAVYYCARDYYGSSPYWGQGTLVTVSS/GKPGSGKPGSGKPGSGKPGS/DVLMTQSPDSLAVSLGERATINCKSSQSIVHSN
GNTYLEWYQQKPGQSPKLLIYKVSNRFSGVPDRFSGSGSGTDFTLTISSLQAEDVAVYYCFQGSHVPNTFGGGTKVEIK

>XENP024442 1C11[PD-1]_H3.194_L3_scFv(GKPGS)4 (SEQ ID NOS 40254-40262 and linker disclosed as SEQ ID NO: 39202)
EIQLVQSGSVLKKPGASVKVSCKASGYTFTHYGINWVRQAPGQGLEWIGWINTYTGEPTYADGFTGRFVFSLDTSVSTAYLQISSL
KAEDTAVYFCARDYYGSSPYWGQGTLVTVSS/GKPGSGKPGSGKPGSGKPGS/DVLMTQSPDSLAVSLGERATINCKSSQSIVHSN
GNTYLEWYQQKPGQSPKLLIYKVSNRFSGVPDRFSGSGSGTDFTLTISSLQAEDVAVYYCFQGSHVPNTFGGGTKVEIK

>XENP024443 1C11[PD-1]_H3.195_L3_scFv(GKPGS)4 (SEQ ID NOS 40263-40271 and linker disclosed as SEQ ID NO: 39202)
QIQLVQSGSELKKPGASVKVSCKASGYTFTHYGMNWVRQPPGQGLEWMGWINTYTGEPYYADGFTGRFVFSLDTSVDTAYLQINSL
KAEDTAVYYCARDYYGSSPYWGQGTLVTVSS/GKPGSGKPGSGKPGSGKPGS/DVLMTQSPDSLAVSLGERATINCKSSQSIVHSN
GNTYLEWYQQKPGQSPKLLIYKVSNRFSGVPDRFSGSGSGTDFTLTISSLQAEDVAVYYCFQGSHVPNTFGGGTKVEIK

>XENP024827 1C11_H3.196_L3_scFv(GKPGS)4 (SEQ ID NOS 40272-40280 and linker disclosed as SEQ ID NO: 39202)
EVQLVQSGSELKKPGESVKVSCKASGYTFTHYGINWVRQPPGQGLEWIGWINTYTGEPYYAPGFTGRFVFSLDTSQSTAYLQINSL
KAEDTAVYYCARDYYGSSPYWGQGTLVTVSS/GKPGSGKPGSGKPGSGKPGS/DVLMTQSPDSLAVSLGERATINCKSSQSIVHSN
GNTYLEWYQQKPGQSPKLLIYKVSNRFSGVPDRFSGSGSGTDFTLTISSLQAEDVAVYYCFQGSHVPNTFGGGTKVEIK

>XENP024828 1C11_H3.197_L3_scFv(GKPGS)4 (SEQ ID NOS 40281-40289 and linker disclosed as SEQ ID NO: 39202)
QVQLVQSGSELKKPGASVKVSCKASGYTFTHYGINWVRQPPGQGLEWIGWINTYTGEPYYAPGFTGRFVFSLDTSQSTAYLQINSL
KAEDTAVYYCARDYYGSSPYWGQGTLVTVSS/GKPGSGKPGSGKPGSGKPGS/DVLMTQSPDSLAVSLGERATINCKSSQSIVHSN
GNTYLEWYQQKPGQSPKLLIYKVSNRFSGVPDRFSGSGSGTDFTLTISSLQAEDVAVYYCFQGSHVPNTFGGGTKVEIK

>XENP024829 1C11_H3.198_L3_scFv(GKPGS)4 (SEQ ID NOS 40290-40298 and linker disclosed as SEQ ID NO: 39202)
QVQLVQSGSELKKPGESVKVSCKASGYTFTHYGINWVRQPPGQGLEWIGWINTYTGEPYYADGFTGRFVFSLDTSQSTAYLQINSL
KAEDTAVYYCARDYYGSSPYWGQGTLVTVSS/GKPGSGKPGSGKPGSGKPGS/DVLMTQSPDSLAVSLGERATINCKSSQSIVHSN
GNTYLEWYQQKPGQSPKLLIYKVSNRFSGVPDRFSGSGSGTDFTLTISSLQAEDVAVYYCFQGSHVPNTFGGGTKVEIK

>XENP024830 1C11_H3.199_L3_scFv(GKPGS)4 (SEQ ID NOS 40299-40307 and linker disclosed as SEQ ID NO: 39202)
QVQLVQSGSELKKPGESVKVSCKASGYTFTHYGMNWVRQPPGQGLEWIGWINTYTGEPYYAPGFTGRFVFSLDTSQSTAYLQINSL
KAEDTAVYYCARDYYGSSPYWGQGTLVTVSS/GKPGSGKPGSGKPGSGKPGS/DVLMTQSPDSLAVSLGERATINCKSSQSIVHSN
GNTYLEWYQQKPGQSPKLLIYKVSNRFSGVPDRFSGSGSGTDFTLTISSLQAEDVAVYYCFQGSHVPNTFGGGTKVEIK

>XENP024831 1C11_H3.200_L3_scFv(GKPGS)4 (SEQ ID NOS 40308-40316 and linker disclosed as SEQ ID NO: 39202)
QVQLVQSGSELKKPGESVKVSCKASGYTFTHYGINWVRQPPGQGLEWIGWINTYTGEPYYAPGFTGRFVFSLDTSQSTAYLQINSL
KAEDTAVYFCARDYYGSSPYWGQGTLVTVSS/GKPGSGKPGSGKPGSGKPGS/DVLMTQSPDSLAVSLGERATINCKSSQSIVHSN
GNTYLEWYQQKPGQSPKLLIYKVSNRFSGVPDRFSGSGSGTDFTLTISSLQAEDVAVYYCFQGSHVPNTFGGGTKVEIK

FIG. 15M

>XENP024832 1C11_H3.201_L3_scFv(GKPGS)4 (SEQ ID NOS 40317-40325 and linker disclosed as SEQ ID NO: 39202)
QVQLVQSGSELKKPGESVKVSCKASGYTFTHYGINWVRQPPGQGLEWIGWINTYTGEPYYAPGFTGRFVFSIDTSQSTAYLQ
INSLKAEDTAVYYCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK

>XENP024833 1C11_H3.202_L3_scFv(GKPGS)4 (SEQ ID NOS 40326-40334 and linker disclosed as SEQ ID NO: 39202)
QVQLVQSGSELKKPGESVKVSCKASGYTFTHYGINWVRQAPGQGLEWIGWINTYTGEPYYAPGFTGRFVFSLDTSQSTAYLQ
INSLKAEDTAVYYCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK

>XENP024834 1C11_H3.203_L3_scFv(GKPGS)4 (SEQ ID NOS 40335-40343 and linker disclosed as SEQ ID NO: 39202)
QVQLVQSGSELKKPGESVKVSCKASGYTFTHYGINWVRQPPGQGLEWIGWINTYTGEPYYAPGFTERFVFSLDTSQSTAYLQ
INSLKAEDTAVYYCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK

>XENP024835 1C11_H3.204_L3_scFv(GKPGS)4 (SEQ ID NOS 40344-40352 and linker disclosed as SEQ ID NO: 39202)
QVQLVQSGSELKKPGESVKVSCKASGYTFTHYGINWVRQPPGQGLEWIGWINTYTGEPYYAPGFQGRFVFSLDTSQSTAYLQ
INSLKAEDTAVYYCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK

>XENP024836 1C11_H3.205_L3_scFv(GKPGS)4 (SEQ ID NOS 40353-40361 and linker disclosed as SEQ ID NO: 39202)
QVQLVQSGSELKKPGESVKVSCKASGYTFTHYGINWVRQPPGQGLEWIGWINTYTGEPYYAPGFKGRFVFSLDTSQSTAYLQ
INSLKAEDTAVYYCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK

>XENP024837 1C11_H3.206_L3_scFv(GKPGS)4 (SEQ ID NOS 40362-40370 and linker disclosed as SEQ ID NO: 39202)
QVQLVQSGSELKKPGESVKVSCKASGYTFTHYGINWVRQPPGQGLEWIGWINTYTGEPTYAPGFTGRFVFSLDTSQSTAYLQ
INSLKAEDTAVYYCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK

>XENP024838 1C11_H3.207_L3_scFv(GKPGS)4 (SEQ ID NOS 40371-40379 and linker disclosed as SEQ ID NO: 39202)
QVQLVQSGSELKKPGESVKVSCKASGYTFTHYGINWVRQPPGQGLEWIGWINTYTGEPYYAPGFTGRFVFSLDTSQSTAYLQ
ISSLKAEDTAVYYCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK

>XENP024839 1C11_H3.208_L3_scFv(GKPGS)4 (SEQ ID NOS 40380-40388 and linker disclosed as SEQ ID NO: 39202)
QVQLVQSGSELKKPGESVKVSCKASGYTFTHYGINWVRQPPGQGLEWIGWINTYTGEPYYAPGFTGRFVFSLDTSQDTAYLQ
INSLKAEDTAVYYCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK

>XENP024840 1C11_H3.209_L3_scFv(GKPGS)4 (SEQ ID NOS 40389-40397 and linker disclosed as SEQ ID NO: 39202)
QVQLVQSGSELKKPGESVKVSCKASGYTFTHYGINWVRQPPGQGLEWMGWINTYTGEPYYAPGFTGRFVFSLDTSQSTAYLQ
INSLKAEDTAVYYCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK

FIG. 15N

>XENP024841 1C11_H3.210_L3_scFv(GKPGS)4 (SEQ ID NOS 40398-40406 and linker disclosed as SEQ ID NO: 39202)
QVQLVQSGSELKKPGESVKVSCKASGYTFTHYGINWVRQPPGQGLEWIGWINTYTGEPYYAPGFTGRFVFSLDTSVSTAYLQ
INSLKAEDTAVYYCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK

>XENP024842 1C11_H3.211_L3_scFv(GKPGS)4 (SEQ ID NOS 40407-40415 and linker disclosed as SEQ ID NO: 39202)
QVQLVQSGPELKKPGESVKVSCKASGYTFTHYGINWVRQPPGQGLEWIGWINTYTGEPYYAPGFTGRFVFSLDTSQSTAYLQ
INSLKAEDTAVYYCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK

>XENP024843 1C11_H3.212_L3_scFv(GKPGS)4 (SEQ ID NOS 40416-40424 and linker disclosed as SEQ ID NO: 39202)
QVQLVQSGSELKKPGESVKVSCKASGYTFTHYGINWVRQPPGQGLEWIGWINTYTGEPYYAPGFTGRFVFSLDTSVDTAYLQ
INSLKAEDTAVYYCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK

>XENP024844 1C11_H3.213_L3_scFv(GKPGS)4 (SEQ ID NOS 40425-40433 and linker disclosed as SEQ ID NO: 39202)
QVQLVQSGPELKKPGESVKVSCKASGYTFTHYGINWVRQAPGQGLEWIGWINTYTGEPYYAPGFTGRFVFSLDTSQDTAYLQ
INSLKAEDTAVYYCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK

>XENP024845 1C11_H3.214_L3_scFv(GKPGS)4 (SEQ ID NOS 40434-40442 and linker disclosed as SEQ ID NO: 39202)
QVQLVQSGPELKKPGESVKVSCKASGYTFTHYGINWVRQAPGQGLEWIGWINTYTGEPYYAPGFTGRFVFSIDTSQSTAYLQ
INSLKAEDTAVYYCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK

>XENP024846 1C11_H3.215_L3_scFv(GKPGS)4 (SEQ ID NOS 40443-40451 and linker disclosed as SEQ ID NO: 39202)
QVQLVQSGPELKKPGESVKVSCKASGYTFTHYGINWVRQAPGQGLEWIGWINTYTGEPYYAPGFTGRFVFSLDTSVSTAYLQ
INSLKAEDTAVYYCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK

>XENP024847 1C11_H3.216_L3_scFv(GKPGS)4 (SEQ ID NOS 40452-40460 and linker disclosed as SEQ ID NO: 39202)
QVQLVQSGPELKKPGESVKVSCKASGYTFTHYGINWVRQPPGQGLEWMGWINTYTGEPYYAPGFTGRFVFSIDTSQSTAYLQ
INSLKAEDTAVYYCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK

>XENP024848 1C11_H3.217_L3_scFv(GKPGS)4 (SEQ ID NOS 40461-40469 and linker disclosed as SEQ ID NO: 39202)
QVQLVQSGPELKKPGESVKVSCKASGYTFTHYGINWVRQPPGQGLEWMGWINTYTGEPYYAPGFTGRFVFSLDTSVSTAYLQ
INSLKAEDTAVYYCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK

>XENP024849 1C11_H3.218_L3_scFv(GKPGS)4 (SEQ ID NOS 40470-40478 and linker disclosed as SEQ ID NO: 39202)
QVQLVQSGPELKKPGESVKVSCKASGYTFTHYGINWVRQPPGQGLEWMGWINTYTGEPYYAPGFTGRFVFSLDTSQDTAYLQ
INSLKAEDTAVYYCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK

FIG. 15O

>XENP024850 1C11_H3.219_L3_scFv(GKPGS)4 (SEQ ID NOS 40479-40487 and linker disclosed as SEQ ID NO: 39202)
QVQLVQSGSELKKPGESVKVSCKASGYTFTHYGINWVRQPPGQGLEWIGWINTYTGEPYYAPGFQERFVFSLDTSQSTAYLQINSL
KAEDTAVYYCARDYYGSSPYWGQGTLVTVSS/GKPGSGKPGSGKPGSGKPGS/DVLMTQSPDSLAVSLGERATINCKSSQSIVHSN
GNTYLEWYQQKPGQSPKLLIYKVSNRFSGVPDRFSGSGSGTDFTLTISSLQAEDVAVYYCFQGSHVPNTFGGGTKVEIK >XENP024851 1C11_H3.220_L3_scFv(GKPGS)4 (SEQ ID NOS 40488-40496 and linker disclosed as SEQ ID NO: 39202)
QVQLVQSGSELKKPGESVKVSCKASGYTFTHYGINWVRQPPGQGLEWIGWINTYTGEPYYAPGFKERFVFSLDTSQSTAYLQINSL
KAEDTAVYYCARDYYGSSPYWGQGTLVTVSS/GKPGSGKPGSGKPGSGKPGS/DVLMTQSPDSLAVSLGERATINCKSSQSIVHSN
GNTYLEWYQQKPGQSPKLLIYKVSNRFSGVPDRFSGSGSGTDFTLTISSLQAEDVAVYYCFQGSHVPNTFGGGTKVEIK >XENP024852 1C11_H3.221_L3_scFv(GKPGS)4 (SEQ ID NOS 40497-40505 and linker disclosed as SEQ ID NO: 39202)
EIQLVQSGSELKKPGESVKVSCKASGYTFTHYGINWVRQPPGQGLEWIGWINTYTGEPYYAPGFTGRFVFSLDTSQSTAYLQINSL
KAEDTAVYYCARDYYGSSPYWGQGTLVTVSS/GKPGSGKPGSGKPGSGKPGS/DVLMTQSPDSLAVSLGERATINCKSSQSIVHSN
GNTYLEWYQQKPGQSPKLLIYKVSNRFSGVPDRFSGSGSGTDFTLTISSLQAEDVAVYYCFQGSHVPNTFGGGTKVEIK >XENP024853 1C11[PD-1]_H3_L3.143_scFv(GKPGS)4 (SEQ ID NOS 40506-40514 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSVSTAYLQISSL
KAEDTAVYFCARDYYGSSPYWGQGTLVTVSS/GKPGSGKPGSGKPGSGKPGS/DIVMTQSPDSLAVSLGERVTINCKASQSIVHSN
GNTYLEWYQQKPGQPPKLLIYKVSNRFSGVPDRFSGSGSGTDFTLTISSVEAEDVATYYCFQGSHVPNTFGQGTKVEIK >XENP024854 1C11[PD-1]_H3_L3.144_scFv(GKPGS)4 (SEQ ID NOS 40515-40523 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSVSTAYLQISSL
KAEDTAVYFCARDYYGSSPYWGQGTLVTVSS/GKPGSGKPGSGKPGSGKPGS/DIVMTQSPDSLAVSLGERVTINCKASQSIVHSN
GNTYLEWYQQKPGQPPKLLIYKVSNRFSGVPDRFSGSGSGTDFTLTISSVEAEDAATYYCFQGSHVPNTFGQGTKVEIK >XENP024855 1C11[PD-1]_H3_L3.145_scFv(GKPGS)4 (SEQ ID NOS 40524-40532 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSVSTAYLQISSL
KAEDTAVYFCARDYYGSSPYWGQGTLVTVSS/GKPGSGKPGSGKPGSGKPGS/DIVMTQSPDSLAVSLGERVTINCKASQSIVHSN
GNTYLEWYQQKPGQSPKLLIYKVSNRFSGVPDRFSGSGSGTDFTLTISSVEAEDVATYYCFQGSHVPNTFGQGTKVEIK >XENP024856 1C11[PD-1]_H3_L3.146_scFv(GKPGS)4 (SEQ ID NOS 40533-40541 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSVSTAYLQISSL
KAEDTAVYFCARDYYGSSPYWGQGTLVTVSS/GKPGSGKPGSGKPGSGKPGS/DIVMTQSPDSLAVSLGERVTINCKASQSIVHSN
GNTYLEWYQQKPGQSPKLLIYKVSNRFSGVPDRFSGSGSGTDFTLTISSVEAEDAATYYCFQGSHVPNTFGQGTKVEIK >XENP024857 1C11[PD-1]_H3_L3.147_scFv(GKPGS)4 (SEQ ID NOS 40542-40550 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSVSTAYLQISSL
KAEDTAVYFCARDYYGSSPYWGQGTLVTVSS/GKPGSGKPGSGKPGSGKPGS/DIVMTQSPDSLAVSLGERVTINCKASQSIVHSN
GNTYLEWYQQKPGQAPKLLIYKVSNRFSGVPDRFSGSGSGTDFTLTISSVEAEDVATYYCFQGSHVPNTFGQGTKVEIK >XENP024858 1C11[PD-1]_H3_L3.148_scFv(GKPGS)4 (SEQ ID NOS 40551-40559 and linker disclosed as SEQ ID NO: 39202)
QIQLVQSGSELKKPGASVKVSCKASGYTFTHYGMNWVRQAPGQGLEWMGWINTYTGEPTYADGFTGRFVFSLDTSVSTAYLQISSL
KAEDTAVYFCARDYYGSSPYWGQGTLVTVSS/GKPGSGKPGSGKPGSGKPGS/DIVMTQSPDSLAVSLGERVTINCKASQSIVHSN
GNTYLEWYQQKPGQAPKLLIYKVSNRFSGVPDRFSGSGSGTDFTLTISSVEAEDAATYYCFQGSHVPNTFGQGTKVEIK

FIG. 15P

>XENP025295 1C11_H3.222_L3_scFv(GKPGS)4 (SEQ ID NOS 40560-40568 and linker disclosed as SEQ ID NO: 39202)
QVQLVQSGPELKKPGESVKVSCKASGYTFTHYGINWVRQPPGQGLEWMGWINTYTGEPTYAPGFTGRFVFSIDTSQSTAYLQ
INSLKAEDTAVYYCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK

>XENP025296 1C11_H3.223_L3_scFv(GKPGS)4 (SEQ ID NOS 40569-40577 and linker disclosed as SEQ ID NO: 39202)
QVQLVQSGPELKKPGESVKVSCKASGYTFTHYGINWVRQPPGQGLEWMGWINTYTGEPYYAPGFTERFVFSIDTSQSTAYLQ
INSLKAEDTAVYYCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK

>XENP025301 1C11_H3.224_L3_scFv(GKPGS)4 (SEQ ID NOS 40578-40586 and linker disclosed as SEQ ID NO: 39202)
QVQLVQSGPELKKPGESVKVSCKASGYTFTHYGINWVRQPPGQGLEWMGWINTYTGEPYYAPGFQERFVFSIDTSQSTAYLQ
INSLKAEDTAVYYCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK

>XENP025302 1C11_H3.225_L3_scFv(GKPGS)4 (SEQ ID NOS 40587-40595 and linker disclosed as SEQ ID NO: 39202)
QVQLVQSGPELKKPGESVKVSCKASGYTFTHYGINWVRQAPGQGLEWMGWINTYTGEPYYAPGFTERFVFSLDTSQDTAYLQ
INSLKAEDTAVYYCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK

>XENP025303 1C11_H3.226_L3_scFv(GKPGS)4 (SEQ ID NOS 40596-40604 and linker disclosed as SEQ ID NO: 39202)
QVQLVQSGPELKKPGESVKVSCKASGYTFTHYGINWVRQAPGQGLEWMGWINTYTGEPYYAPGFQERFVFSLDTSQDTAYLQ
INSLKAEDTAVYYCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK

>XENP025304 1C11_H3.227_L3_scFv(GKPGS)4 (SEQ ID NOS 40605-40613 and linker disclosed as SEQ ID NO: 39202)
EVQLVQSGPELKKPGESVKVSCKASGYTFTHYGINWVRQAPGQGLEWMGWINTYTGEPYYAPGFTERFVFSLDTSQDTAYLQ
INSLKAEDTAVYYCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK

>XENP025305 1C11_H3.228_L3_scFv(GKPGS)4 (SEQ ID NOS 40614-40622 and linker disclosed as SEQ ID NO: 39202)
EVQLVQSGPELKKPGESVKVSCKASGYTFTHYGINWVRQAPGQGLEWMGWINTYTGEPYYAPGFQERFVFSLDTSQDTAYLQ
INSLKAEDTAVYYCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK

>XENP025306 1C11_H3.229_L3_scFv(GKPGS)4 (SEQ ID NOS 40623-40631 and linker disclosed as SEQ ID NO: 39202)
QVQLVQSGSELKKPGESVKVSCKASGYTFTHYGINWVRQPPGQGLEWMGWINTYTGEPYYAPGFQERFVFSLDTSQSTAYLQ
INSLKAEDTAVYYCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK

>XENP025307 1C11_H3.230_L3_scFv(GKPGS)4 (SEQ ID NOS 40632-40640 and linker disclosed as SEQ ID NO: 39202)
QVQLVQSGSELKKPGESVKVSCKASGYTFTHYGINWVRQPPGQGLEWMGWINTYTGEPYYAPGFQERFVFSLDTSQDTAYLQ
INSLKAEDTAVYYCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK

FIG. 15Q

>XENP025308 1C11_H3.231_L3_scFv(GKPGS)4 (SEQ ID NOS 40641-40649 and linker disclosed as SEQ ID NO: 39202)
QVQLVQSGSELKKPGESVKVSCKASGYTFTHYGINWVRQPPGQGLEWMGWINTYTGEPTYAPGFTGRFVFSLDTSQSTAYLQ
ISSLKAEDTAVYYCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK

>XENP025309 1C11_H3.232_L3_scFv(GKPGS)4 (SEQ ID NOS 40650-40658 and linker disclosed as SEQ ID NO: 39202)
QVQLVQSGSELKKPGESVKVSCKASGYTFTHYGINWVRQPPGQGLEWMGWINTYTGEPTYAPGFTGRFVFSLDTSQDTAYLQ
INSLKAEDTAVYYCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK

>XENP025310 1C11_H3.233_L3_scFv(GKPGS)4 (SEQ ID NOS 40659-40667 and linker disclosed as SEQ ID NO: 39202)
EVQLVQSGSELKKPGESVKVSCKASGYTFTHYGINWVRQPPGQGLEWMGWINTYTGEPYYAPGFQERFVFSLDTSQSTAYLQ
INSLKAEDTAVYYCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK

>XENP025311 1C11_H3.234_L3_scFv(GKPGS)4 (SEQ ID NOS 40668-40676 and linker disclosed as SEQ ID NO: 39202)
EVQLVQSGSELKKPGESVKVSCKASGYTFTHYGINWVRQPPGQGLEWMGWINTYTGEPYYAPGFQERFVFSLDTSQDTAYLQ
INSLKAEDTAVYYCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK

>XENP025312 1C11_H3.235_L3_scFv(GKPGS)4 (SEQ ID NOS 40677-40685 and linker disclosed as SEQ ID NO: 39202)
EVQLVQSGSELKKPGESVKVSCKASGYTFTHYGINWVRQPPGQGLEWMGWINTYTGEPTYAPGFTGRFVFSLDTSQSTAYLQ
ISSLKAEDTAVYYCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK

>XENP025313 1C11_H3.236_L3_scFv(GKPGS)4 (SEQ ID NOS 40686-40694 and linker disclosed as SEQ ID NO: 39202)
EVQLVQSGSELKKPGESVKVSCKASGYTFTHYGINWVRQPPGQGLEWMGWINTYTGEPTYAPGFTGRFVFSLDTSQDTAYLQ
INSLKAEDTAVYYCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK

>XENP025314 1C11_H3.237_L3_scFv(GKPGS)4 (SEQ ID NOS 40695-40703 and linker disclosed as SEQ ID NO: 39202)
QVQLVQSGSELKKPGESVKVSCKASGYTFTHYGINWVRQAPGQGLEWMGWINTYTGEPYYAPGFTERFVFSLDTSQDTAYLQ
INSLKAEDTAVYYCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK

>XENP025315 1C11_H3.238_L3_scFv(GKPGS)4 (SEQ ID NOS 40704-40712 and linker disclosed as SEQ ID NO: 39202)
QVQLVQSGSELKKPGESVKVSCKASGYTFTHYGINWVRQAPGQGLEWMGWINTYTGEPYYAPGFQERFVFSLDTSQDTAYLQ
INSLKAEDTAVYYCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK

>XENP025316 1C11_H3.213_L3.144_scFv(GKPGS)4 (SEQ ID NOS 40713-40721 and linker disclosed as SEQ ID NO: 39202)
QVQLVQSGPELKKPGESVKVSCKASGYTFTHYGINWVRQAPGQGLEWIGWINTYTGEPYYAPGFTGRFVFSLDTSQDTAYLQ
INSLKAEDTAVYYCARDYYGSSPYWGQGTLVTVSS/GKPGSGKPGSGKPGSGKPGS/DIVMTQSPDSLAVSLGERVTINCKA
SQSIVHSNGNTYLEWYQQKPGQPPKLLIYKVSNRFSGVPDRFSGSGSGTDFTLTISSVEAEDAATYYCFQGSHVPNTFGQGT
KVEIK

FIG. 15R

>XENP025317 1C11_H3.213_L3.148_scFv(GKPGS)4 (SEQ ID NOS 40722-40730 and linker disclosed as SEQ ID NO: 39202)
QVQLVQSGPELKKPGESVKVSCKASGYTFTHYGINWVRQAPGQGLEWIGWINTYTGEPYYAPGFTGRFVFSLDTSQDTAYLQINSL
KAEDTAVYYCARDYYGSSPYWGQGTLVTVSS/GKPGSGKPGSGKPGSGKPGS/DIVMTQSPDSLAVSLGERVTINCKASQSIVHSN
GNTYLEWYQQKPGQAPKLLIYKVSNRFSGVPDRFSGSGSGTDFTLTISSVEAEDAATYYCFQGSHVPNTFGQGTKVEIK

>XENP025318 1C11_H3.216_L3.144_scFv(GKPGS)4 (SEQ ID NOS 40731-40739 and linker disclosed as SEQ ID NO: 39202)
QVQLVQSGPELKKPGESVKVSCKASGYTFTHYGINWVRQPPGQGLEWMGWINTYTGEPYYAPGFTGRFVFSIDTSQSTAYLQINSL
KAEDTAVYYCARDYYGSSPYWGQGTLVTVSS/GKPGSGKPGSGKPGSGKPGS/DIVMTQSPDSLAVSLGERVTINCKASQSIVHSN
GNTYLEWYQQKPGQPPKLLIYKVSNRFSGVPDRFSGSGSGTDFTLTISSVEAEDAATYYCFQGSHVPNTFGQGTKVEIK

>XENP025319 1C11_H3.216_L3.148_scFv(GKPGS)4 (SEQ ID NOS 40740-40748 and linker disclosed as SEQ ID NO: 39202)
QVQLVQSGPELKKPGESVKVSCKASGYTFTHYGINWVRQPPGQGLEWMGWINTYTGEPYYAPGFTGRFVFSIDTSQSTAYLQINSL
KAEDTAVYYCARDYYGSSPYWGQGTLVTVSS/GKPGSGKPGSGKPGSGKPGS/DIVMTQSPDSLAVSLGERVTINCKASQSIVHSN
GNTYLEWYQQKPGQAPKLLIYKVSNRFSGVPDRFSGSGSGTDFTLTISSVEAEDAATYYCFQGSHVPNTFGQGTKVEIK

>XENP025320 1C11_H3.188_L3.144_scFv(GKPGS)4 (SEQ ID NOS 40749-40757 and linker disclosed as SEQ ID NO: 39202)
QVQLVQSGSELKKPGESVKVSCKASGYTFTHYGINWVRQPPGQGLEWIGWINTYTGEPYYAPGFTGRFVFSLDTSQSTAYLQINSL
KAEDTAVYYCARDYYGSSPYWGQGTLVTVSS/GKPGSGKPGSGKPGSGKPGS/DIVMTQSPDSLAVSLGERVTINCKASQSIVHSN
GNTYLEWYQQKPGQPPKLLIYKVSNRFSGVPDRFSGSGSGTDFTLTISSVEAEDAATYYCFQGSHVPNTFGQGTKVEIK

>XENP025321 1C11_H3.188_L3.148_scFv(GKPGS)4 (SEQ ID NOS 40758-40766 and linker disclosed as SEQ ID NO: 39202)
QVQLVQSGSELKKPGESVKVSCKASGYTFTHYGINWVRQPPGQGLEWIGWINTYTGEPYYAPGFTGRFVFSLDTSQSTAYLQINSL
KAEDTAVYYCARDYYGSSPYWGQGTLVTVSS/GKPGSGKPGSGKPGSGKPGS/DIVMTQSPDSLAVSLGERVTINCKASQSIVHSN
GNTYLEWYQQKPGQAPKLLIYKVSNRFSGVPDRFSGSGSGTDFTLTISSVEAEDAATYYCFQGSHVPNTFGQGTKVEIK

>XENP025802 1C11[PD-1]_H3.224_L3.144_scFv(GKPGS)4 (SEQ ID NOS 40767-40775 and linker disclosed as SEQ ID NO: 39202)
QVQLVQSGPELKKPGESVKVSCKASGYTFTHYGINWVRQPPGQGLEWMGWINTYTGEPYYAPGFQERFVFSIDTSQSTAYLQINSL
KAEDTAVYYCARDYYGSSPYWGQGTLVTVSS/GKPGSGKPGSGKPGSGKPGS/DIVMTQSPDSLAVSLGERVTINCKASQSIVHSN
GNTYLEWYQQKPGQPPKLLIYKVSNRFSGVPDRFSGSGSGTDFTLTISSVEAEDAATYYCFQGSHVPNTFGQGTKVEIK

>XENP025803 1C11[PD-1]_H3.224_L3.148_scFv(GKPGS)4 (SEQ ID NOS 40776-40784 and linker disclosed as SEQ ID NO: 39202)
QVQLVQSGPELKKPGESVKVSCKASGYTFTHYGINWVRQPPGQGLEWMGWINTYTGEPYYAPGFQERFVFSIDTSQSTAYLQINSL
KAEDTAVYYCARDYYGSSPYWGQGTLVTVSS/GKPGSGKPGSGKPGSGKPGS/DIVMTQSPDSLAVSLGERVTINCKASQSIVHSN
GNTYLEWYQQKPGQAPKLLIYKVSNRFSGVPDRFSGSGSGTDFTLTISSVEAEDAATYYCFQGSHVPNTFGQGTKVEIK

>XENP025804 1C11[PD-1]_H3.228_L3.144_scFv(GKPGS)4 (SEQ ID NOS 40785-40793 and linker disclosed as SEQ ID NO: 39202)
EVQLVQSGPELKKPGESVKVSCKASGYTFTHYGINWVRQAPGQGLEWMGWINTYTGEPYYAPGFQERFVFSLDTSQDTAYLQINSL
KAEDTAVYYCARDYYGSSPYWGQGTLVTVSS/GKPGSGKPGSGKPGSGKPGS/DIVMTQSPDSLAVSLGERVTINCKASQSIVHSN
GNTYLEWYQQKPGQPPKLLIYKVSNRFSGVPDRFSGSGSGTDFTLTISSVEAEDAATYYCFQGSHVPNTFGQGTKVEIK

>XENP025805 1C11[PD-1]_H3.228_L3.148_scFv(GKPGS)4 (SEQ ID NOS 40794-40802 and linker disclosed as SEQ ID NO: 39202)
EVQLVQSGPELKKPGESVKVSCKASGYTFTHYGINWVRQAPGQGLEWMGWINTYTGEPYYAPGFQERFVFSLDTSQDTAYLQINSL
KAEDTAVYYCARDYYGSSPYWGQGTLVTVSS/GKPGSGKPGSGKPGSGKPGS/DIVMTQSPDSLAVSLGERVTINCKASQSIVHSN
GNTYLEWYQQKPGQAPKLLIYKVSNRFSGVPDRFSGSGSGTDFTLTISSVEAEDAATYYCFQGSHVPNTFGQGTKVEIK

FIG. 15S

>XENP025806 1C11[PD-1]_H3.234_L3.144_scFv(GKPGS)4 (SEQ ID NOS 40803-40811 and linker disclosed as SEQ ID NO: 39202)
EVQLVQSGSELKKPGESVKVSCKASGYTFTHYGINWVRQPPGQGLEWMGWINTYTGEPYYAPGFQERFVFSLDTSQDTAYLQINSL
KAEDTAVYYCARDYYGSSPYWGQGTLVTVSS/GKPGSGKPGSGKPGSGKPGS/DIVMTQSPDSLAVSLGERVTINCKASQSIVHSN
GNTYLEWYQQKPGQPPKLLIYKVSNRFSGVPDRFSGSGSGTDFTLTISSVEAEDAATYYCFQGSHVPNTFGQGTKVEIK

>XENP025807 1C11[PD-1]_H3.234_L3.148_scFv(GKPGS)4 (SEQ ID NOS 40812-40820 and linker disclosed as SEQ ID NO: 39202)
EVQLVQSGSELKKPGESVKVSCKASGYTFTHYGINWVRQPPGQGLEWMGWINTYTGEPYYAPGFQERFVFSLDTSQDTAYLQINSL
KAEDTAVYYCARDYYGSSPYWGQGTLVTVSS/GKPGSGKPGSGKPGSGKPGS/DIVMTQSPDSLAVSLGERVTINCKASQSIVHSN
GNTYLEWYQQKPGQAPKLLIYKVSNRFSGVPDRFSGSGSGTDFTLTISSVEAEDAATYYCFQGSHVPNTFGQGTKVEIK

>XENP025808 1C11[PD-1]_H3.239_L3.144_scFv(GKPGS)4 (SEQ ID NOS 40821-40829 and linker disclosed as SEQ ID NO: 39202)
EVQLVQSGPELKKPGESVKVSCKASGYTFTHYGINWVRQPPGQGLEWMGWINTYTGEPYYAPGFQERFVFSIDTSQSTAYLQINSL
KAEDTAVYYCARDYYGSSPYWGQGTLVTVSS/GKPGSGKPGSGKPGSGKPGS/DVLMTQSPDSLAVSLGERATINCKSSQSIVHSN
GNTYLEWYQQKPGQSPKLLIYKVSNRFSGVPDRFSGSGSGTDFTLTISSLQAEDVAVYYCFQGSHVPNTFGGGTKVEIK

>XENP025809 1C11[PD-1]_H3.240_L3.144_scFv(GKPGS)4 (SEQ ID NOS 40830-40838 and linker disclosed as SEQ ID NO: 39202)
QVQLVQSGPELKKPGESVKVSCKASGYTFTHYGINWVRQPPGQGLEWMGWINTYTGEPYYAPGFQERFVFSIDTSQDTAYLQINSL
KAEDTAVYYCARDYYGSSPYWGQGTLVTVSS/GKPGSGKPGSGKPGSGKPGS/DVLMTQSPDSLAVSLGERATINCKSSQSIVHSN
GNTYLEWYQQKPGQSPKLLIYKVSNRFSGVPDRFSGSGSGTDFTLTISSLQAEDVAVYYCFQGSHVPNTFGGGTKVEIK

>XENP025810 1C11[PD-1]_H3.241_L3.144_scFv(GKPGS)4 (SEQ ID NOS 40839-40847 and linker disclosed as SEQ ID NO: 39202)
EVQLVQSGPELKKPGESVKVSCKASGYTFTHYGINWVRQPPGQGLEWMGWINTYTGEPYYAPGFQERFVFSIDTSQDTAYLQINSL
KAEDTAVYYCARDYYGSSPYWGQGTLVTVSS/GKPGSGKPGSGKPGSGKPGS/DVLMTQSPDSLAVSLGERATINCKSSQSIVHSN
GNTYLEWYQQKPGQSPKLLIYKVSNRFSGVPDRFSGSGSGTDFTLTISSLQAEDVAVYYCFQGSHVPNTFGGGTKVEIK

>XENP025811 1C11[PD-1]_H3.239_L3.148_scFv(GKPGS)4 (SEQ ID NOS 40848-40856 and linker disclosed as SEQ ID NO: 39202)
EVQLVQSGPELKKPGESVKVSCKASGYTFTHYGINWVRQPPGQGLEWMGWINTYTGEPYYAPGFQERFVFSIDTSQSTAYLQINSL
KAEDTAVYYCARDYYGSSPYWGQGTLVTVSS/GKPGSGKPGSGKPGSGKPGS/DVLMTQSPDSLAVSLGERATINCKSSQSIVHSN
GNTYLEWYQQKPGQSPKLLIYKVSNRFSGVPDRFSGSGSGTDFTLTISSLQAEDVAVYYCFQGSHVPNTFGGGTKVEIK

>XENP025812 1C11[PD-1]_H3.240_L3.148_scFv(GKPGS)4 (SEQ ID NOS 40857-40865 and linker disclosed as SEQ ID NO: 39202)
QVQLVQSGPELKKPGESVKVSCKASGYTFTHYGINWVRQPPGQGLEWMGWINTYTGEPYYAPGFQERFVFSIDTSQDTAYLQINSL
KAEDTAVYYCARDYYGSSPYWGQGTLVTVSS/GKPGSGKPGSGKPGSGKPGS/DVLMTQSPDSLAVSLGERATINCKSSQSIVHSN
GNTYLEWYQQKPGQSPKLLIYKVSNRFSGVPDRFSGSGSGTDFTLTISSLQAEDVAVYYCFQGSHVPNTFGGGTKVEIK

>XENP025813 1C11[PD-1]_H3.241_L3.148_scFv(GKPGS)4 (SEQ ID NOS 40866-40874 and linker disclosed as SEQ ID NO: 39202)
EVQLVQSGPELKKPGESVKVSCKASGYTFTHYGINWVRQPPGQGLEWMGWINTYTGEPYYAPGFQERFVFSIDTSQDTAYLQINSL
KAEDTAVYYCARDYYGSSPYWGQGTLVTVSS/GKPGSGKPGSGKPGSGKPGS/DVLMTQSPDSLAVSLGERATINCKSSQSIVHSN
GNTYLEWYQQKPGQSPKLLIYKVSNRFSGVPDRFSGSGSGTDFTLTISSLQAEDVAVYYCFQGSHVPNTFGGGTKVEIK

>XENP025814 1C11[PD-1]_H3.239_L3.125_scFv(GKPGS)4 (SEQ ID NOS 40875-40883 and linker disclosed as SEQ ID NO: 39202)
EVQLVQSGPELKKPGESVKVSCKASGYTFTHYGINWVRQPPGQGLEWMGWINTYTGEPYYAPGFQERFVFSIDTSQSTAYLQINSL
KAEDTAVYYCARDYYGSSPYWGQGTLVTVSS/GKPGSGKPGSGKPGSGKPGS/DVLMTQSPDSLAVSLGERATINCKSSQSIVHSN
GNTYLEWYQQKPGQSPKLLIYKVSNRFSGVPDRFSGSGSGTDFTLTISSVEAEDVAVYYCFQGSHVPNTFGGGTKVEIK

FIG. 15T

>XENP025815 1C11[PD-1]_H3.240_L3.125_scFv(GKPGS)4 (SEQ ID NOS 40884-40892 and linker disclosed as SEQ ID NO: 39202)
QVQLVQSGPELKKPGESVKVSCKASGYTFTHYGINWVRQPPGQGLEWMGWINTYTGEPYYAPGFQERFVFSIDTSQD
TAYLQINSLKAEDTAVYYCARDYYGSSPYWGQGTLVTVSS/GKPGSGKPGSGKPGSGKPGS/DVLMTQSPDSLAVSL
GERATINCKSSQSIVHSNGNTYLEWYQQKPGQSPKLLIYKVSNRFSGVPDRFSGSGSGTDFTLTISSVEAEDVAVYY
CFQGSHVPNTFGGGTKVEIK

>XENP025816 1C11[PD-1]_H3.241_L3.125_scFv(GKPGS)4 (SEQ ID NOS 40893-40901 and linker disclosed as SEQ ID NO: 39202)
EVQLVQSGPELKKPGESVKVSCKASGYTFTHYGINWVRQPPGQGLEWMGWINTYTGEPYYAPGFQERFVFSIDTSQD
TAYLQINSLKAEDTAVYYCARDYYGSSPYWGQGTLVTVSS/GKPGSGKPGSGKPGSGKPGS/DVLMTQSPDSLAVSL
GERATINCKSSQSIVHSNGNTYLEWYQQKPGQSPKLLIYKVSNRFSGVPDRFSGSGSGTDFTLTISSVEAEDVAVYY
CFQGSHVPNTFGGGTKVEIK

>XENP025817 1C11[PD-1]_H3.239_L3.92_scFv(GKPGS)4 (SEQ ID NOS 40902-40910 and linker disclosed as SEQ ID NO: 39202)
EVQLVQSGPELKKPGESVKVSCKASGYTFTHYGINWVRQPPGQGLEWMGWINTYTGEPYYAPGFQERFVFSIDTSQS
TAYLQINSLKAEDTAVYYCARDYYGSSPYWGQGTLVTVSS/GKPGSGKPGSGKPGSGKPGS/DIVMTQSPDSLAVSL
GERVTINCKASQSIVHSNGNTYLEWYQQKPGQPPKLLIYKVSNRFTGVPDRFSGSGSGTDFTLTISSLQAEDVAVYY
CFQGSHVPNTFGGGTKVEIK

>XENP025818 1C11[PD-1]_H3.240_L3.92_scFv(GKPGS)4 (SEQ ID NOS 40911-40919 and linker disclosed as SEQ ID NO: 39202)
QVQLVQSGPELKKPGESVKVSCKASGYTFTHYGINWVRQPPGQGLEWMGWINTYTGEPYYAPGFQERFVFSIDTSQD
TAYLQINSLKAEDTAVYYCARDYYGSSPYWGQGTLVTVSS/GKPGSGKPGSGKPGSGKPGS/DIVMTQSPDSLAVSL
GERVTINCKASQSIVHSNGNTYLEWYQQKPGQPPKLLIYKVSNRFTGVPDRFSGSGSGTDFTLTISSLQAEDVAVYY
CFQGSHVPNTFGGGTKVEIK

>XENP025819 1C11[PD-1]_H3.241_L3.92_scFv(GKPGS)4 (SEQ ID NOS 40920-40928 and linker disclosed as SEQ ID NO: 39202)
EVQLVQSGPELKKPGESVKVSCKASGYTFTHYGINWVRQPPGQGLEWMGWINTYTGEPYYAPGFQERFVFSIDTSQD
TAYLQINSLKAEDTAVYYCARDYYGSSPYWGQGTLVTVSS/GKPGSGKPGSGKPGSGKPGS/DIVMTQSPDSLAVSL
GERVTINCKASQSIVHSNGNTYLEWYQQKPGQPPKLLIYKVSNRFTGVPDRFSGSGSGTDFTLTISSLQAEDVAVYY
CFQGSHVPNTFGGGTKVEIK

FIG. 16A

XENP025322 1C11_H3.223_L3_IgG1_PVA_/S267K Heavy Chain (SEQ ID NOS 40929-40933)
QVQLVQSGPELKKPGESVKVSCKASGYTFT<u>HYGIN</u>WVRQPPGQGLEWMG<u>WINTYTGEPYYAPGFTERF</u>VFSIDTSQSTAYLQINSLKAEDTAVYYCA
RD<u>YYGSSPYW</u>GQGTLVTVSS/ASTKGPSVFPLAPSSKSTSGGTAALGCLVKDYFPEPVTVSWNSGALTSGVHTFPAVLQSSGLYSLSSVVTVPSSSL
GTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNVFSCSVMHEALHNHYTQKSLSLSPGK

>XENP025322 1C11_H3.223_L3_IgG1_PVA_/S267K Light Chain (SEQ ID NOS 40934-40938)
DVLMTQSPDSLAVSLGERATINC<u>KSSQSIVHSNGNTYLE</u>WYQQKPGQSPKLLIY<u>KVSNRFS</u>GVPDRFSGSGSGTDFTLTISSLQAEDVAVYYC<u>FQGS
HVPNT</u>FGGGTKVEIK/RTVAAPSVFIFPPSDEQLKSGTASVVCLLNNFYPREAKVQWKVDNALQSGNSQESVTEQDSKDSTYSLSSTLTLSKADYEK
HKVYACEVTHQGLSSPVTKSFNRGEC

>XENP025323 1C11_H3.224_L3_IgG1_PVA_/S267K Heavy Chain (SEQ ID NOS 40939-40943)
QVQLVQSGPELKKPGESVKVSCKASGYTFT<u>HYGIN</u>WVRQPPGQGLEWMG<u>WINTYTGEPYYAPGFQERF</u>VFSIDTSQSTAYLQINSLKAEDTAVYYCA
RD<u>YYGSSPYW</u>GQGTLVTVSS/ASTKGPSVFPLAPSSKSTSGGTAALGCLVKDYFPEPVTVSWNSGALTSGVHTFPAVLQSSGLYSLSSVVTVPSSSL
GTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNVFSCSVMHEALHNHYTQKSLSLSPGK

>XENP025323 1C11_H3.224_L3_IgG1_PVA_/S267K Light Chain (SEQ ID NOS 40944-40948)
DVLMTQSPDSLAVSLGERATINC<u>KSSQSIVHSNGNTYLE</u>WYQQKPGQSPKLLIY<u>KVSNRFS</u>GVPDRFSGSGSGTDFTLTISSLQAEDVAVYYC<u>FQGS
HVPNT</u>FGGGTKVEIK/RTVAAPSVFIFPPSDEQLKSGTASVVCLLNNFYPREAKVQWKVDNALQSGNSQESVTEQDSKDSTYSLSSTLTLSKADYEK
HKVYACEVTHQGLSSPVTKSFNRGEC

>XENP025324 1C11_H3.225_L3_IgG1_PVA_/S267K Heavy Chain (SEQ ID NOS 40949-40953)
QVQLVQSGPELKKPGESVKVSCKASGYTFT<u>HYGIN</u>WVRQAPGQGLEWMG<u>WINTYTGEPYYAPGFTERF</u>VFSLDTSQDTAYLQINSLKAEDTAVYYCA
RD<u>YYGSSPYW</u>GQGTLVTVSS/ASTKGPSVFPLAPSSKSTSGGTAALGCLVKDYFPEPVTVSWNSGALTSGVHTFPAVLQSSGLYSLSSVVTVPSSSL
GTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNVFSCSVMHEALHNHYTQKSLSLSPGK

>XENP025324 1C11_H3.225_L3_IgG1_PVA_/S267K Light Chain (SEQ ID NOS 40954-40958)
DVLMTQSPDSLAVSLGERATINC<u>KSSQSIVHSNGNTYLE</u>WYQQKPGQSPKLLIY<u>KVSNRFS</u>GVPDRFSGSGSGTDFTLTISSLQAEDVAVYYC<u>FQGS
HVPNT</u>FGGGTKVEIK/RTVAAPSVFIFPPSDEQLKSGTASVVCLLNNFYPREAKVQWKVDNALQSGNSQESVTEQDSKDSTYSLSSTLTLSKADYEK
HKVYACEVTHQGLSSPVTKSFNRGEC

>XENP025325 1C11_H3.226_L3_IgG1_PVA_/S267K Heavy Chain (SEQ ID NOS 40959-40963)
QVQLVQSGPELKKPGESVKVSCKASGYTFT<u>HYGIN</u>WVRQAPGQGLEWMG<u>WINTYTGEPYYAPGFQERF</u>VFSLDTSQDTAYLQINSLKAEDTAVYYCA
RD<u>YYGSSPYW</u>GQGTLVTVSS/ASTKGPSVFPLAPSSKSTSGGTAALGCLVKDYFPEPVTVSWNSGALTSGVHTFPAVLQSSGLYSLSSVVTVPSSSL
GTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNVFSCSVMHEALHNHYTQKSLSLSPGK

>XENP025325 1C11_H3.226_L3_IgG1_PVA_/S267K Light Chain (SEQ ID NOS 40964-40968)
DVLMTQSPDSLAVSLGERATINC<u>KSSQSIVHSNGNTYLE</u>WYQQKPGQSPKLLIY<u>KVSNRFS</u>GVPDRFSGSGSGTDFTLTISSLQAEDVAVYYC<u>FQGS
HVPNT</u>FGGGTKVEIK/RTVAAPSVFIFPPSDEQLKSGTASVVCLLNNFYPREAKVQWKVDNALQSGNSQESVTEQDSKDSTYSLSSTLTLSKADYEK
HKVYACEVTHQGLSSPVTKSFNRGEC

>XENP025326 1C11_H3.229_L3_IgG1_PVA_/S267K Heavy Chain (SEQ ID NOS 40969-40973)
QVQLVQSGSELKKPGESVKVSCKASGYTFT<u>HYGIN</u>WVRQPPGQGLEWMG<u>WINTYTGEPYYAPGFQERF</u>VFSIDTSQSTAYLQINSLKAEDTAVYYCA
RD<u>YYGSSPYW</u>GQGTLVTVSS/ASTKGPSVFPLAPSSKSTSGGTAALGCLVKDYFPEPVTVSWNSGALTSGVHTFPAVLQSSGLYSLSSVVTVPSSSL
GTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNVFSCSVMHEALHNHYTQKSLSLSPGK

>XENP025326 1C11_H3.229_L3_IgG1_PVA_/S267K Light Chain (SEQ ID NOS 40974-40978)
DVLMTQSPDSLAVSLGERATINC<u>KSSQSIVHSNGNTYLE</u>WYQQKPGQSPKLLIY<u>KVSNRFS</u>GVPDRFSGSGSGTDFTLTISSLQAEDVAVYYC<u>FQGS
HVPNT</u>FGGGTKVEIK/RTVAAPSVFIFPPSDEQLKSGTASVVCLLNNFYPREAKVQWKVDNALQSGNSQESVTEQDSKDSTYSLSSTLTLSKADYEK
HKVYACEVTHQGLSSPVTKSFNRGEC

>XENP025327 1C11_H3.230_L3_IgG1_PVA_/S267K Heavy Chain (SEQ ID NOS 40979-40983)
QVQLVQSGSELKKPGESVKVSCKASGYTFT<u>HYGIN</u>WVRQPPGQGLEWMG<u>WINTYTGEPYYAPGFQERF</u>VFSLDTSQDTAYLQINSLKAEDTAVYYCA
RD<u>YYGSSPYW</u>GQGTLVTVSS/ASTKGPSVFPLAPSSKSTSGGTAALGCLVKDYFPEPVTVSWNSGALTSGVHTFPAVLQSSGLYSLSSVVTVPSSSL
GTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNVFSCSVMHEALHNHYTQKSLSLSPGK

FIG. 16B

>XENP025327 1C11_H3.230_L3_IgG1_PVA_/S267K Light Chain (SEQ ID NOS 40984-40988)
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGS
HVPNTFGGGTKVEIK/RTVAAPSVFIFPPSDEQLKSGTASVVCLLNNFYPREAKVQWKVDNALQSGNSQESVTEQDSKDSTYSLSSTLTLSKADYEK
HKVYACEVTHQGLSSPVTKSFNRGEC

>XENP025328 1C11_H3.231_L3_IgG1_PVA_/S267K Heavy Chain (SEQ ID NOS 40989-40993)
QVQLVQSGSELKKPGESVKVSCKASGYTFTHYGINWVRQPPGQGLEWMGWINTYTGEPTYAPGFTGRFVFSLDTSQSTAYLQISSLKAEDTAVYYCA
RDYYGSSPYWGQGTLVTVSS/ASTKGPSVFPLAPSSKSTSGGTAALGCLVKDYFPEPVTVSWNSGALTSGVHTFPAVLQSSGLYSLSSVVTVPSSSL
GTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNVFSCSVMHEALHNHYTQKSLSLSPGK

>XENP025328 1C11_H3.231_L3_IgG1_PVA_/S267K Light Chain (SEQ ID NOS 40994-40998)
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGS
HVPNTFGGGTKVEIK/RTVAAPSVFIFPPSDEQLKSGTASVVCLLNNFYPREAKVQWKVDNALQSGNSQESVTEQDSKDSTYSLSSTLTLSKADYEK
HKVYACEVTHQGLSSPVTKSFNRGEC

>XENP025329 1C11_H3.232_L3_IgG1_PVA_/S267K Heavy Chain (SEQ ID NOS 40999-41003)
QVQLVQSGSELKKPGESVKVSCKASGYTFTHYGINWVRQPPGQGLEWMGWINTYTGEPTYAPGFTGRFVFSLDTSQDTAYLQINSLKAEDTAVYYCA
RDYYGSSPYWGQGTLVTVSS/ASTKGPSVFPLAPSSKSTSGGTAALGCLVKDYFPEPVTVSWNSGALTSGVHTFPAVLQSSGLYSLSSVVTVPSSSL
GTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNVFSCSVMHEALHNHYTQKSLSLSPGK

>XENP025329 1C11_H3.232_L3_IgG1_PVA_/S267K Light Chain (SEQ ID NOS 41004-41008)
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGS
HVPNTFGGGTKVEIK/RTVAAPSVFIFPPSDEQLKSGTASVVCLLNNFYPREAKVQWKVDNALQSGNSQESVTEQDSKDSTYSLSSTLTLSKADYEK
HKVYACEVTHQGLSSPVTKSFNRGEC

>XENP025330 1C11_H3.235_L3_IgG1_PVA_/S267K Heavy Chain (SEQ ID NOS 41009-41013)
EVQLVQSGSELKKPGESVKVSCKASGYTFTHYGINWVRQPPGQGLEWMGWINTYTGEPTYAPGFTGRFVFSLDTSQSTAYLQISSLKAEDTAVYYCA
RDYYGSSPYWGQGTLVTVSS/ASTKGPSVFPLAPSSKSTSGGTAALGCLVKDYFPEPVTVSWNSGALTSGVHTFPAVLQSSGLYSLSSVVTVPSSSL
GTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNVFSCSVMHEALHNHYTQKSLSLSPGK

>XENP025330 1C11_H3.235_L3_IgG1_PVA_/S267K Light Chain (SEQ ID NOS 41014-41018)
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGS
HVPNTFGGGTKVEIK/RTVAAPSVFIFPPSDEQLKSGTASVVCLLNNFYPREAKVQWKVDNALQSGNSQESVTEQDSKDSTYSLSSTLTLSKADYEK
HKVYACEVTHQGLSSPVTKSFNRGEC

>XENP025331 1C11_H3.236_L3_IgG1_PVA_/S267K Heavy Chain (SEQ ID NOS 41019-41023)
EVQLVQSGSELKKPGESVKVSCKASGYTFTHYGINWVRQPPGQGLEWMGWINTYTGEPTYAPGFTGRFVFSLDTSQDTAYLQINSLKAEDTAVYYCA
RDYYGSSPYWGQGTLVTVSS/ASTKGPSVFPLAPSSKSTSGGTAALGCLVKDYFPEPVTVSWNSGALTSGVHTFPAVLQSSGLYSLSSVVTVPSSSL
GTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNVFSCSVMHEALHNHYTQKSLSLSPGK

>XENP025331 1C11_H3.236_L3_IgG1_PVA_/S267K Light Chain (SEQ ID NOS 41024-41028)
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGS
HVPNTFGGGTKVEIK/RTVAAPSVFIFPPSDEQLKSGTASVVCLLNNFYPREAKVQWKVDNALQSGNSQESVTEQDSKDSTYSLSSTLTLSKADYEK
HKVYACEVTHQGLSSPVTKSFNRGEC

>XENP025332 1C11_H3.237_L3_IgG1_PVA_/S267K Heavy Chain (SEQ ID NOS 41029-41033)
QVQLVQSGSELKKPGESVKVSCKASGYTFTHYGINWVRQAPGQGLEWMGWINTYTGEPYYAPGFTERPVFSLDTSQDTAYLQINSLKAEDTAVYYCA
RDYYGSSPYWGQGTLVTVSS/ASTKGPSVFPLAPSSKSTSGGTAALGCLVKDYFPEPVTVSWNSGALTSGVHTFPAVLQSSGLYSLSSVVTVPSSSL
GTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNVFSCSVMHEALHNHYTQKSLSLSPGK

>XENP025332 1C11_H3.237_L3_IgG1_PVA_/S267K Light Chain (SEQ ID NOS 41034-41038)
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGS
HVPNTFGGGTKVEIK/RTVAAPSVFIFPPSDEQLKSGTASVVCLLNNFYPREAKVQWKVDNALQSGNSQESVTEQDSKDSTYSLSSTLTLSKADYEK
HKVYACEVTHQGLSSPVTKSFNRGEC

FIG. 16C

>XENP025333 1C11_H3.238_L3_IgG1_PVA_/S267K Heavy Chain (SEQ ID NOS 41039-41043)
QVQLVQSGSELKKPGESVKVSCKASGYTFT<u>HYGIN</u>WVRQAPGQGLEWMG<u>WINTYTGEPYYAPGFQER</u>FVFSLDTSQDTAYLQINSLKAEDTAVYYCA
RD<u>YYGSSPY</u>WGQGTLVTVSS/ASTKGPSVFPLAPSSKSTSGGTAALGCLVKDYFPEPVTVSWNSGALTSGVHTFPAVLQSSGLYSLSSVVTVPSSSL
GTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNVFSCSVMHEALHNHYTQKSLSLSPGK

>XENP025333 1C11_H3.238_L3_IgG1_PVA_/S267K Light Chain (SEQ ID NOS 41044-41048)
DVLMTQSPDSLAVSLGERATINC<u>KSSQSIVHSNGNTYLE</u>WYQQKPGQSPKLLIY<u>KVSNRF</u>SGVPDRFSGSGSGTDFTLTISSLQAEDVAVYYC<u>FQGS
HVPNT</u>FGGGTKVEIK/RTVAAPSVFIFPPSDEQLKSGTASVVCLLNNFYPREAKVQWKVDNALQSGNSQESVTEQDSKDSTYSLSSTLTLSKADYEK
HKVYACEVTHQGLSSPVTKSFNRGEC

>XENP025334 1C11[PD-1]_H3.188_L3.144_IgG1_PVA_/S267K Heavy Chain (SEQ ID NOS 41049-41053)
QVQLVQSGSELKKPGESVKVSCKASGYTFT<u>HYGIN</u>WVRQPPGQGLEWIG<u>WINTYTGEPYYAPGFTGR</u>FVFSLDTSQSTAYLQINSLKAEDTAVYYCA
RD<u>YYGSSPY</u>WGQGTLVTVSS/ASTKGPSVFPLAPSSKSTSGGTAALGCLVKDYFPEPVTVSWNSGALTSGVHTFPAVLQSSGLYSLSSVVTVPSSSL
GTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNVFSCSVMHEALHNHYTQKSLSLSPGK

>XENP025334 1C11[PD-1]_H3.188_L3.144_IgG1_PVA_/S267K Light Chain (SEQ ID NOS 41054-41058)
DIVMTQSPDSLAVSLGERVTINC<u>KASQSIVHSNGNTYLE</u>WYQQKPGQPPKLLIY<u>KVSNRF</u>SGVPDRFSGSGSGTDFTLTISSVEAEDAATYYC<u>FQGS
HVPNT</u>FGQGTKVEIK/RTVAAPSVFIFPPSDEQLKSGTASVVCLLNNFYPREAKVQWKVDNALQSGNSQESVTEQDSKDSTYSLSSTLTLSKADYEK
HKVYACEVTHQGLSSPVTKSFNRGEC

>XENP025335 1C11[PD-1]_H3.188_L3.148_IgG1_PVA_/S267K Heavy Chain (SEQ ID NOS 41059-41063)
QVQLVQSGSELKKPGESVKVSCKASGYTFT<u>HYGIN</u>WVRQPPGQGLEWIG<u>WINTYTGEPYYAPGFTGR</u>FVFSLDTSQSTAYLQINSLKAEDTAVYYCA
RD<u>YYGSSPY</u>WGQGTLVTVSS/ASTKGPSVFPLAPSSKSTSGGTAALGCLVKDYFPEPVTVSWNSGALTSGVHTFPAVLQSSGLYSLSSVVTVPSSSL
GTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNVFSCSVMHEALHNHYTQKSLSLSPGK

>XENP025335 1C11[PD-1]_H3.188_L3.148_IgG1_PVA_/S267K Light Chain (SEQ ID NOS 41064-41068)
DIVMTQSPDSLAVSLGERVTINC<u>KASQSIVHSNGNTYLE</u>WYQQKPGQAPKLLIY<u>KVSNRF</u>SGVPDRFSGSGSGTDFTLTISSVEAEDAATYYC<u>FQGS
HVPNT</u>FGQGTKVEIK/RTVAAPSVFIFPPSDEQLKSGTASVVCLLNNFYPREAKVQWKVDNALQSGNSQESVTEQDSKDSTYSLSSTLTLSKADYEK
HKVYACEVTHQGLSSPVTKSFNRGEC

>XENP025336 1C11[PD-1]_H3.224_L3.144_IgG1_PVA_/S267K Heavy Chain (SEQ ID NOS 41069-41073)
QVQLVQSGPELKKPGESVKVSCKASGYTFT<u>HYGIN</u>WVRQPPGQGLEWMG<u>WINTYTGEPYYAPGFQER</u>FVFSIDTSQSTAYLQINSLKAEDTAVYYCA
RD<u>YYGSSPY</u>WGQGTLVTVSS/ASTKGPSVFPLAPSSKSTSGGTAALGCLVKDYFPEPVTVSWNSGALTSGVHTFPAVLQSSGLYSLSSVVTVPSSSL
GTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNVFSCSVMHEALHNHYTQKSLSLSPGK

>XENP025336 1C11[PD-1]_H3.224_L3.144_IgG1_PVA_/S267K Light Chain (SEQ ID NOS 41074-41078)
DIVMTQSPDSLAVSLGERVTINC<u>KASQSIVHSNGNTYLE</u>WYQQKPGQPPKLLIY<u>KVSNRF</u>SGVPDRFSGSGSGTDFTLTISSVEAEDAATYYC<u>FQGS
HVPNT</u>FGQGTKVEIK/RTVAAPSVFIFPPSDEQLKSGTASVVCLLNNFYPREAKVQWKVDNALQSGNSQESVTEQDSKDSTYSLSSTLTLSKADYEK
HKVYACEVTHQGLSSPVTKSFNRGEC

>XENP025337 1C11[PD-1]_H3.224_L3.148_IgG1_PVA_/S267K Heavy Chain (SEQ ID NOS 41079-41083)
QVQLVQSGPELKKPGESVKVSCKASGYTFT<u>HYGIN</u>WVRQPPGQGLEWMG<u>WINTYTGEPYYAPGFQER</u>FVFSIDTSQSTAYLQINSLKAEDTAVYYCA
RD<u>YYGSSPY</u>WGQGTLVTVSS/ASTKGPSVFPLAPSSKSTSGGTAALGCLVKDYFPEPVTVSWNSGALTSGVHTFPAVLQSSGLYSLSSVVTVPSSSL
GTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNVFSCSVMHEALHNHYTQKSLSLSPGK

>XENP025337 1C11[PD-1]_H3.224_L3.148_IgG1_PVA_/S267K Light Chain (SEQ ID NOS 41084-41088)
DIVMTQSPDSLAVSLGERVTINC<u>KASQSIVHSNGNTYLE</u>WYQQKPGQAPKLLIY<u>KVSNRF</u>SGVPDRFSGSGSGTDFTLTISSVEAEDAATYYC<u>FQGS
HVPNT</u>FGQGTKVEIK/RTVAAPSVFIFPPSDEQLKSGTASVVCLLNNFYPREAKVQWKVDNALQSGNSQESVTEQDSKDSTYSLSSTLTLSKADYEK
HKVYACEVTHQGLSSPVTKSFNRGEC

>XENP025338 1C11[PD-1]_H3.226_L3.144_IgG1_PVA_/S267K Heavy Chain (SEQ ID NOS 41089-41093)
QVQLVQSGPELKKPGESVKVSCKASGYTFT<u>HYGIN</u>WVRQAPGQGLEWMG<u>WINTYTGEPYYAPGFQER</u>FVFSLDTSQDTAYLQINSLKAEDTAVYYCA
RD<u>YYGSSPY</u>WGQGTLVTVSS/ASTKGPSVFPLAPSSKSTSGGTAALGCLVKDYFPEPVTVSWNSGALTSGVHTFPAVLQSSGLYSLSSVVTVPSSSL
GTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNVFSCSVMHEALHNHYTQKSLSLSPGK

FIG. 16D

>XENP025338 1C11[PD-1]_H3.226_L3.144_IgG1_PVA_/S267K Light Chain (SEQ ID NOS 41094-41098)
DIVMTQSPDSLAVSLGERVTINCKASQSIVHSNGNTYLEWYQQKPGQPPKLLIYKVSNRFSGVPDRFSGSGSGTDFTLTISSVEAEDAATYYCFQGS
HVPNTFGQGTKVEIK/RTVAAPSVFIFPPSDEQLKSGTASVVCLLNNFYPREAKVQWKVDNALQSGNSQESVTEQDSKDSTYSLSSTLTLSKADYEK
HKVYACEVTHQGLSSPVTKSFNRGEC

>XENP025339 1C11[PD-1]_H3.226_L3.148_IgG1_PVA_/S267K Heavy Chain (SEQ ID NOS 41099-41103)
QVQLVQSGPELKKPGESVKVSCKASGYTFTHYGINWVRQAPGQGLEWMGWINTYTGEPYYAPGFQERFVFSLDTSQDTAYLQINSLKAEDTAVYYCA
RDYYGSSPYWGQGTLVTVSS/ASTKGPSVFPLAPSSKSTSGGTAALGCLVKDYFPEPVTVSWNSGALTSGVHTFPAVLQSSGLYSLSSVVTVPSSSL
GTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNVFSCSVMHEALHNHYTQKSLSLSPGK

>XENP025339 1C11[PD-1]_H3.226_L3.148_IgG1_PVA_/S267K Light Chain (SEQ ID NOS 41104-41108)
DIVMTQSPDSLAVSLGERVTINCKASQSIVHSNGNTYLEWYQQKPGQAPKLLIYKVSNRFSGVPDRFSGSGSGTDFTLTISSVEAEDAATYYCFQGS
HVPNTFGQGTKVEIK/RTVAAPSVFIFPPSDEQLKSGTASVVCLLNNFYPREAKVQWKVDNALQSGNSQESVTEQDSKDSTYSLSSTLTLSKADYEK
HKVYACEVTHQGLSSPVTKSFNRGEC

>XENP025340 1C11[PD-1]_H3.188_L3_IgG1_PVA_/S267K Heavy Chain (SEQ ID NOS 41109-41113)
QVQLVQSGSELKKPGESVKVSCKASGYTFTHYGINWVRQPPGQGLEWIGWINTYTGEPYYAPGFTGRFVFSLDTSQSTAYLQINSLKAEDTAVYYCA
RDYYGSSPYWGQGTLVTVSS/ASTKGPSVFPLAPSSKSTSGGTAALGCLVKDYFPEPVTVSWNSGALTSGVHTFPAVLQSSGLYSLSSVVTVPSSSL
GTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNVFSCSVMHEALHNHYTQKSLSLSPGK

>XENP025340 1C11[PD-1]_H3.188_L3_IgG1_PVA_/S267K Light Chain (SEQ ID NOS 41114-41118)
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGS
HVPNTFGGGTKVEIK/RTVAAPSVFIFPPSDEQLKSGTASVVCLLNNFYPREAKVQWKVDNALQSGNSQESVTEQDSKDSTYSLSSTLTLSKADYEK
HKVYACEVTHQGLSSPVTKSFNRGEC

>XENP025341 1C11[PD-1]_H3_L3.141_IgG1_PVA_/S267K Heavy Chain (SEQ ID NOS 41119-41123)
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCA
RDYYGSSPYWGQGTLVTVSS/ASTKGPSVFPLAPSSKSTSGGTAALGCLVKDYFPEPVTVSWNSGALTSGVHTFPAVLQSSGLYSLSSVVTVPSSSL
GTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNVFSCSVMHEALHNHYTQKSLSLSPGK

>XENP025341 1C11[PD-1]_H3_L3.141_IgG1_PVA_/S267K Light Chain (SEQ ID NOS 41124-41128)
DIVMTQSPDSLAVSLGERATINCKASQSIVHSNGNTYLEWYQQKPGQPPKLLIYKVSNRFSGVPDRFSGSGSGTDFTLTISSVEAEDVATYYCFQGS
HVPNTFGQGTKVEIK/RTVAAPSVFIFPPSDEQLKSGTASVVCLLNNFYPREAKVQWKVDNALQSGNSQESVTEQDSKDSTYSLSSTLTLSKADYEK
HKVYACEVTHQGLSSPVTKSFNRGEC

>XENP025342 1C11[PD-1]_H3_L3.142_IgG1_PVA_/S267K Heavy Chain (SEQ ID NOS 41129-41133)
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCA
RDYYGSSPYWGQGTLVTVSS/ASTKGPSVFPLAPSSKSTSGGTAALGCLVKDYFPEPVTVSWNSGALTSGVHTFPAVLQSSGLYSLSSVVTVPSSSL
GTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNVFSCSVMHEALHNHYTQKSLSLSPGK

>XENP025342 1C11[PD-1]_H3_L3.142_IgG1_PVA_/S267K Light Chain (SEQ ID NOS 41134-41138)
DIVMTQSPDSLAVSLGERATINCKASQSIVHSNGNTYLEWYQQKPGQAPKLLIYKVSNRFSGVPDRFSGSGSGTDFTLTISSVEAEDVATYYCFQGS
HVPNTFGQGTKVEIK/RTVAAPSVFIFPPSDEQLKSGTASVVCLLNNFYPREAKVQWKVDNALQSGNSQESVTEQDSKDSTYSLSSTLTLSKADYEK
HKVYACEVTHQGLSSPVTKSFNRGEC

>XENP025820 1C11[PD-1]_H3_L3.144_IgG1_PVA_/S267K Heavy Chain (SEQ ID NOS 41139-41143)
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCA
RDYYGSSPYWGQGTLVTVSS/ASTKGPSVFPLAPSSKSTSGGTAALGCLVKDYFPEPVTVSWNSGALTSGVHTFPAVLQSSGLYSLSSVVTVPSSSL
GTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNVFSCSVMHEALHNHYTQKSLSLSPGK

>XENP025820 1C11[PD-1]_H3_L3.144_IgG1_PVA_/S267K Light Chain (SEQ ID NOS 41144-41148)
DIVMTQSPDSLAVSLGERVTINCKASQSIVHSNGNTYLEWYQQKPGQPPKLLIYKVSNRFSGVPDRFSGSGSGTDFTLTISSVEAEDAATYYCFQGS
HVPNTFGQGTKVEIK/RTVAAPSVFIFPPSDEQLKSGTASVVCLLNNFYPREAKVQWKVDNALQSGNSQESVTEQDSKDSTYSLSSTLTLSKADYEK
HKVYACEVTHQGLSSPVTKSFNRGEC

FIG. 16E

>XENP025821 1C11[PD-1]_H3_L3.148_IgG1_PVA_/S267K Heavy Chain (SEQ ID NOS 41149-41153)
QIQLVQSGSELKKPGASVKVSCKASGYTFT<u>HYGMN</u>WVRQAPGQGLEWMG<u>WINTYTGEPTYADGFTGR</u>FVFSLDTSVSTAYLQISSLKAEDTAVYFCA
R<u>DYYGSSPY</u>WGQGTLVTVSS/ASTKGPSVFPLAPSSKSTSGGTAALGCLVKDYFPEPVTVSWNSGALTSGVHTFPAVLQSSGLYSLSSVVTVPSSSL
GTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNVFSCSVMHEALHNHYTQKSLSLSPGK

>XENP025821 1C11[PD-1]_H3_L3.148_IgG1_PVA_/S267K Light Chain (SEQ ID NOS 41154-41158)
DIVMTQSPDSLAVSLGERVTINC<u>KASQSIVHSNGNTYLE</u>WYQQKPGQAPKLLIY<u>KVSNRFS</u>GVPDRFSGSGSGTDFTLTISSVEAEDAATYYC<u>FQGS
HVPNT</u>FGQGTKVEIK/RTVAAPSVFIFPPSDEQLKSGTASVVCLLNNFYPREAKVQWKVDNALQSGNSQESVTEQDSKDSTYSLSSTLTLSKADYEK
HKVYACEVTHQGLSSPVTKSFNRGEC

>XENP025822 1C11[PD-1]_H3.216_L3_IgG1_PVA_/S267K Heavy Chain (SEQ ID NOS 41159-41163)
QVQLVQSGPELKKPGESVKVSCKASGYTFT<u>HYGIN</u>WVRQPPGQGLEWMG<u>WINTYTGEPYYAPGFTGR</u>FVFSIDTSQSTAYLQINSLKAEDTAVYYCA
R<u>DYYGSSPY</u>WGQGTLVTVSS/ASTKGPSVFPLAPSSKSTSGGTAALGCLVKDYFPEPVTVSWNSGALTSGVHTFPAVLQSSGLYSLSSVVTVPSSSL
GTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNVFSCSVMHEALHNHYTQKSLSLSPGK

>XENP025822 1C11[PD-1]_H3.216_L3_IgG1_PVA_/S267K Light Chain (SEQ ID NOS 41164-41168)
DVLMTQSPDSLAVSLGERATINC<u>KSSQSIVHSNGNTYLE</u>WYQQKPGQSPKLLIY<u>KVSNRFS</u>GVPDRFSGSGSGTDFTLTISSLQAEDVAVYYC<u>FQGS
HVPNT</u>FGGGTKVEIK/RTVAAPSVFIFPPSDEQLKSGTASVVCLLNNFYPREAKVQWKVDNALQSGNSQESVTEQDSKDSTYSLSSTLTLSKADYEK
HKVYACEVTHQGLSSPVTKSFNRGEC

XENP025823 1C11[PD-1]_H3.228_L3_IgG1_PVA_/S267K Heavy Chain (SEQ ID NOS 41169-41173)
EVQLVQSGPELKKPGESVKVSCKASGYTFT<u>HYGIN</u>WVRQAPGQGLEWMG<u>WINTYTGEPYYAPGFQER</u>FVFSLDTSQDTAYLQINSLKAEDTAVYYCA
R<u>DYYGSSPY</u>WGQGTLVTVSS/ASTKGPSVFPLAPSSKSTSGGTAALGCLVKDYFPEPVTVSWNSGALTSGVHTFPAVLQSSGLYSLSSVVTVPSSSL
GTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNVFSCSVMHEALHNHYTQKSLSLSPGK

>XENP025823 1C11[PD-1]_H3.228_L3_IgG1_PVA_/S267K Light Chain (SEQ ID NOS 41174-41178)
DVLMTQSPDSLAVSLGERATINC<u>KSSQSIVHSNGNTYLE</u>WYQQKPGQSPKLLIY<u>KVSNRFS</u>GVPDRFSGSGSGTDFTLTISSLQAEDVAVYYC<u>FQGS
HVPNT</u>FGGGTKVEIK/RTVAAPSVFIFPPSDEQLKSGTASVVCLLNNFYPREAKVQWKVDNALQSGNSQESVTEQDSKDSTYSLSSTLTLSKADYEK
HKVYACEVTHQGLSSPVTKSFNRGEC

>XENP025824 1C11[PD-1]_H3.234_L3_IgG1_PVA_/S267K Heavy Chain (SEQ ID NOS 41179-41183)
EVQLVQSGSELKKPGESVKVSCKASGYTFT<u>HYGIN</u>WVRQPPGQGLEWMG<u>WINTYTGEPYYAPGFQER</u>FVFSLDTSQDTAYLQINSLKAEDTAVYYCA
R<u>DYYGSSPY</u>WGQGTLVTVSS/ASTKGPSVFPLAPSSKSTSGGTAALGCLVKDYFPEPVTVSWNSGALTSGVHTFPAVLQSSGLYSLSSVVTVPSSSL
GTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNVFSCSVMHEALHNHYTQKSLSLSPGK

>XENP025824 1C11[PD-1]_H3.234_L3_IgG1_PVA_/S267K Light Chain (SEQ ID NOS 41184-41188)
DVLMTQSPDSLAVSLGERATINC<u>KSSQSIVHSNGNTYLE</u>WYQQKPGQSPKLLIY<u>KVSNRFS</u>GVPDRFSGSGSGTDFTLTISSLQAEDVAVYYC<u>FQGS
HVPNT</u>FGGGTKVEIK/RTVAAPSVFIFPPSDEQLKSGTASVVCLLNNFYPREAKVQWKVDNALQSGNSQESVTEQDSKDSTYSLSSTLTLSKADYEK
HKVYACEVTHQGLSSPVTKSFNRGEC

>XENP025825 1C11[PD-1]_H3.239_L3.144_IgG1_PVA_/S267K Heavy Chain (SEQ ID NOS 41189-41193)
EVQLVQSGPELKKPGESVKVSCKASGYTFT<u>HYGIN</u>WVRQPPGQGLEWMG<u>WINTYTGEPYYAPGFQER</u>FVFSIDTSQSTAYLQINSLKAEDTAVYYCA
R<u>DYYGSSPY</u>WGQGTLVTVSS/ASTKGPSVFPLAPSSKSTSGGTAALGCLVKDYFPEPVTVSWNSGALTSGVHTFPAVLQSSGLYSLSSVVTVPSSSL
GTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNVFSCSVMHEALHNHYTQKSLSLSPGK

>XENP025825 1C11[PD-1]_H3.239_L3.144_IgG1_PVA_/S267K Light Chain (SEQ ID NOS 41194-41198)
DIVMTQSPDSLAVSLGERVTINC<u>KASQSIVHSNGNTYLE</u>WYQQKPGQPPKLLIY<u>KVSNRFS</u>GVPDRFSGSGSGTDFTLTISSVEAEDAATYYC<u>FQGS
HVPNT</u>FGQGTKVEIK/RTVAAPSVFIFPPSDEQLKSGTASVVCLLNNFYPREAKVQWKVDNALQSGNSQESVTEQDSKDSTYSLSSTLTLSKADYEK
HKVYACEVTHQGLSSPVTKSFNRGEC

>XENP025826 1C11[PD-1]_H3.240_L3.144_IgG1_PVA_/S267K Heavy Chain (SEQ ID NOS 41199-41203)
QVQLVQSGPELKKPGESVKVSCKASGYTFT<u>HYGIN</u>WVRQPPGQGLEWMG<u>WINTYTGEPYYAPGFQER</u>FVFSIDTSQDTAYLQINSLKAEDTAVYYCA
R<u>DYYGSSPY</u>WGQGTLVTVSS/ASTKGPSVFPLAPSSKSTSGGTAALGCLVKDYFPEPVTVSWNSGALTSGVHTFPAVLQSSGLYSLSSVVTVPSSSL
GTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNVFSCSVMHEALHNHYTQKSLSLSPGK

FIG. 16F

>XENP025826 1C11[PD-1]_H3.240_L3.144_IgG1_PVA_/S267K Light Chain (SEQ ID NOS 41204-41208)
DIVMTQSPDSLAVSLGERVTINCKASQSIVHSNGNTYLEWYQQKPGQPPKLLIYKVSNRFSGVPDRFSGSGSGTDFTLTISSVEAEDAATYYCFQGS
HVPNTFGQGTKVEIK/RTVAAPSVFIFPPSDEQLKSGTASVVCLLNNFYPREAKVQWKVDNALQSGNSQESVTEQDSKDSTYSLSSTLTLSKADYEK
HKVYACEVTHQGLSSPVTKSFNRGEC

>XENP025827 1C11[PD-1]_H3.241_L3.144_IgG1_PVA_/S267K Heavy Chain (SEQ ID NOS 41209-41213)
EVQLVQSGPELKKPGESVKVSCKASGYTFTHYGINWVRQPPGQGLEWMGWINTYTGEPYYAPGFQERFVFSIDTSQDTAYLQINSLKAEDTAVYYCA
RDYYGSSPYWGQGTLVTVSS/ASTKGPSVFPLAPSSKSTSGGTAALGCLVKDYFPEPVTVSWNSGALTSGVHTFPAVLQSSGLYSLSSVVTVPSSSL
GTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNVFSCSVMHEALHNHYTQKSLSLSPGK

>XENP025827 1C11[PD-1]_H3.241_L3.144_IgG1_PVA_/S267K Light Chain (SEQ ID NOS 41214-41218)
DIVMTQSPDSLAVSLGERVTINCKASQSIVHSNGNTYLEWYQQKPGQPPKLLIYKVSNRFSGVPDRFSGSGSGTDFTLTISSVEAEDAATYYCFQGS
HVPNTFGQGTKVEIK/RTVAAPSVFIFPPSDEQLKSGTASVVCLLNNFYPREAKVQWKVDNALQSGNSQESVTEQDSKDSTYSLSSTLTLSKADYEK
HKVYACEVTHQGLSSPVTKSFNRGEC

>XENP025828 1C11[PD-1]_H3.239_L3.148_IgG1_PVA_/S267K Heavy Chain (SEQ ID NOS 41219-41223)
EVQLVQSGPELKKPGESVKVSCKASGYTFTHYGINWVRQPPGQGLEWMGWINTYTGEPYYAPGFQERFVFSIDTSQSTAYLQINSLKAEDTAVYYCA
RDYYGSSPYWGQGTLVTVSS/ASTKGPSVFPLAPSSKSTSGGTAALGCLVKDYFPEPVTVSWNSGALTSGVHTFPAVLQSSGLYSLSSVVTVPSSSL
GTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNVFSCSVMHEALHNHYTQKSLSLSPGK

>XENP025828 1C11[PD-1]_H3.239_L3.148_IgG1_PVA_/S267K Light Chain (SEQ ID NOS 41224-41228)
DIVMTQSPDSLAVSLGERVTINCKASQSIVHSNGNTYLEWYQQKPGQAPKLLIYKVSNRFSGVPDRFSGSGSGTDFTLTISSVEAEDAATYYCFQGS
HVPNTFGQGTKVEIK/RTVAAPSVFIFPPSDEQLKSGTASVVCLLNNFYPREAKVQWKVDNALQSGNSQESVTEQDSKDSTYSLSSTLTLSKADYEK
HKVYACEVTHQGLSSPVTKSFNRGEC

>XENP025829 1C11[PD-1]_H3.240_L3.148_IgG1_PVA_/S267K Heavy Chain (SEQ ID NOS 41229-41233)
QVQLVQSGPELKKPGESVKVSCKASGYTFTHYGINWVRQPPGQGLEWMGWINTYTGEPYYAPGFQERFVFSIDTSQDTAYLQINSLKAEDTAVYYCA
RDYYGSSPYWGQGTLVTVSS/ASTKGPSVFPLAPSSKSTSGGTAALGCLVKDYFPEPVTVSWNSGALTSGVHTFPAVLQSSGLYSLSSVVTVPSSSL
GTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNVFSCSVMHEALHNHYTQKSLSLSPGK

>XENP025829 1C11[PD-1]_H3.240_L3.148_IgG1_PVA_/S267K Light Chain (SEQ ID NOS 41234-41238)
DIVMTQSPDSLAVSLGERVTINCKASQSIVHSNGNTYLEWYQQKPGQAPKLLIYKVSNRFSGVPDRFSGSGSGTDFTLTISSVEAEDAATYYCFQGS
HVPNTFGQGTKVEIK/RTVAAPSVFIFPPSDEQLKSGTASVVCLLNNFYPREAKVQWKVDNALQSGNSQESVTEQDSKDSTYSLSSTLTLSKADYEK
HKVYACEVTHQGLSSPVTKSFNRGEC

>XENP025830 1C11[PD-1]_H3.241_L3.148_IgG1_PVA_/S267K Heavy Chain (SEQ ID NOS 41239-41243)
EVQLVQSGPELKKPGESVKVSCKASGYTFTHYGINWVRQPPGQGLEWMGWINTYTGEPYYAPGFQERFVFSIDTSQDTAYLQINSLKAEDTAVYYCA
RDYYGSSPYWGQGTLVTVSS/ASTKGPSVFPLAPSSKSTSGGTAALGCLVKDYFPEPVTVSWNSGALTSGVHTFPAVLQSSGLYSLSSVVTVPSSSL
GTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNVFSCSVMHEALHNHYTQKSLSLSPGK

>XENP025830 1C11[PD-1]_H3.241_L3.148_IgG1_PVA_/S267K Light Chain (SEQ ID NOS 41244-41248)
DIVMTQSPDSLAVSLGERVTINCKASQSIVHSNGNTYLEWYQQKPGQAPKLLIYKVSNRFSGVPDRFSGSGSGTDFTLTISSVEAEDAATYYCFQGS
HVPNTFGQGTKVEIK/RTVAAPSVFIFPPSDEQLKSGTASVVCLLNNFYPREAKVQWKVDNALQSGNSQESVTEQDSKDSTYSLSSTLTLSKADYEK
HKVYACEVTHQGLSSPVTKSFNRGEC

>XENP025831 1C11[PD-1]_H3.216_L3.144_IgG1_PVA_/S267K Heavy Chain (SEQ ID NOS 41249-41253)
QVQLVQSGPELKKPGESVKVSCKASGYTFTHYGINWVRQPPGQGLEWMGWINTYTGEPYYAPGFTGRFVFSIDTSQSTAYLQINSLKAEDTAVYYCA
RDYYGSSPYWGQGTLVTVSS/ASTKGPSVFPLAPSSKSTSGGTAALGCLVKDYFPEPVTVSWNSGALTSGVHTFPAVLQSSGLYSLSSVVTVPSSSL
GTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNVFSCSVMHEALHNHYTQKSLSLSPGK

>XENP025831 1C11[PD-1]_H3.216_L3.144_IgG1_PVA_/S267K Light Chain (SEQ ID NOS 41254-41258)
DIVMTQSPDSLAVSLGERVTINCKASQSIVHSNGNTYLEWYQQKPGQPPKLLIYKVSNRFSGVPDRFSGSGSGTDFTLTISSVEAEDAATYYCFQGS
HVPNTFGQGTKVEIK/RTVAAPSVFIFPPSDEQLKSGTASVVCLLNNFYPREAKVQWKVDNALQSGNSQESVTEQDSKDSTYSLSSTLTLSKADYEK
HKVYACEVTHQGLSSPVTKSFNRGEC

FIG. 16G

>XENP025832 1C11[PD-1]_H3.216_L3.148_IgG1_PVA_/S267K Heavy Chain (SEQ ID NOS 41259-41263)
QVQLVQSGPELKKPGESVKVSCKASGYTFT<u>HYGIN</u>WVRQPPGQGLEWMG<u>WINTYTGEPYYAPGFTG</u>RFVFSIDTSQDTAYLQINSLKAEDTAVYYCA
R<u>DYYGSSPYW</u>GQGTLVTVSS/ASTKGPSVFPLAPSSKSTSGGTAALGCLVKDYFPEPVTVSWNSGALTSGVHTFPAVLQSSGLYSLSSVVTVPSSSL
GTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNVFSCSVMHEALHNHYTQKSLSLSPGK

>XENP025832 1C11[PD-1]_H3.216_L3.148_IgG1_PVA_/S267K Light Chain (SEQ ID NOS 41264-41268)
DIVMTQSPDSLAVSLGERVTINC<u>KASQSIVHSNGNTYLE</u>WYQQKPGQAPKLLIY<u>KVSNRF</u>SGVPDRFSGSGSGTDFTLTISSVEAEDAATYYC<u>FQGS
HVPNT</u>FGQGTKVEIK/RTVAAPSVFIFPPSDEQLKSGTASVVCLLNNFYPREAKVQWKVDNALQSGNSQESVTEQDSKDSTYSLSSTLTLSKADYEK
HKVYACEVTHQGLSSPVTKSFNRGEC

>XENP025833 1C11[PD-1]_H3.228_L3.144_IgG1_PVA_/S267K Heavy Chain (SEQ ID NOS 41269-41273)
EVQLVQSGPELKKPGESVKVSCKASGYTFT<u>HYGIN</u>WVRQAPGQGLEWMG<u>WINTYTGEPYYAPGFQE</u>RFVFSLDTSQDTAYLQINSLKAEDTAVYYCA
R<u>DYYGSSPYW</u>GQGTLVTVSS/ASTKGPSVFPLAPSSKSTSGGTAALGCLVKDYFPEPVTVSWNSGALTSGVHTFPAVLQSSGLYSLSSVVTVPSSSL
GTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNVFSCSVMHEALHNHYTQKSLSLSPGK

>XENP025833 1C11[PD-1]_H3.228_L3.144_IgG1_PVA_/S267K Light Chain (SEQ ID NOS 41274-41278)
DIVMTQSPDSLAVSLGERVTINC<u>KASQSIVHSNGNTYLE</u>WYQQKPGQPPKLLIY<u>KVSNRF</u>SGVPDRFSGSGSGTDFTLTISSVEAEDAATYYC<u>FQGS
HVPNT</u>FGQGTKVEIK/RTVAAPSVFIFPPSDEQLKSGTASVVCLLNNFYPREAKVQWKVDNALQSGNSQESVTEQDSKDSTYSLSSTLTLSKADYEK
HKVYACEVTHQGLSSPVTKSFNRGEC

>XENP025834 1C11[PD-1]_H3.228_L3.148_IgG1_PVA_/S267K Heavy Chain (SEQ ID NOS 41279-41283)
EVQLVQSGPELKKPGESVKVSCKASGYTFT<u>HYGIN</u>WVRQAPGQGLEWMG<u>WINTYTGEPYYAPGFQE</u>RFVFSLDTSQDTAYLQINSLKAEDTAVYYCA
R<u>DYYGSSPYW</u>GQGTLVTVSS/ASTKGPSVFPLAPSSKSTSGGTAALGCLVKDYFPEPVTVSWNSGALTSGVHTFPAVLQSSGLYSLSSVVTVPSSSL
GTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNVFSCSVMHEALHNHYTQKSLSLSPGK

>XENP025834 1C11[PD-1]_H3.228_L3.148_IgG1_PVA_/S267K Light Chain (SEQ ID NOS 41284-41288)
DIVMTQSPDSLAVSLGERVTINC<u>KASQSIVHSNGNTYLE</u>WYQQKPGQAPKLLIY<u>KVSNRF</u>SGVPDRFSGSGSGTDFTLTISSVEAEDAATYYC<u>FQGS
HVPNT</u>FGQGTKVEIK/RTVAAPSVFIFPPSDEQLKSGTASVVCLLNNFYPREAKVQWKVDNALQSGNSQESVTEQDSKDSTYSLSSTLTLSKADYEK
HKVYACEVTHQGLSSPVTKSFNRGEC

XENP025835 1C11[PD-1]_H3.234_L3.144_IgG1_PVA_/S267K Heavy Chain (SEQ ID NOS 41289-41293)
EVQLVQSGSELKKPGESVKVSCKASGYTFT<u>HYGIN</u>WVRQPPGQGLEWMG<u>WINTYTGEPYYAPGFQE</u>RFVFSLDTSQDTAYLQINSLKAEDTAVYYCA
R<u>DYYGSSPYW</u>GQGTLVTVSS/ASTKGPSVFPLAPSSKSTSGGTAALGCLVKDYFPEPVTVSWNSGALTSGVHTFPAVLQSSGLYSLSSVVTVPSSSL
GTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNVFSCSVMHEALHNHYTQKSLSLSPGK

>XENP025835 1C11[PD-1]_H3.234_L3.144_IgG1_PVA_/S267K Light Chain (SEQ ID NOS 41294-41298)
DIVMTQSPDSLAVSLGERVTINC<u>KASQSIVHSNGNTYLE</u>WYQQKPGQPPKLLIY<u>KVSNRF</u>SGVPDRFSGSGSGTDFTLTISSVEAEDAATYYC<u>FQGS
HVPNT</u>FGQGTKVEIK/RTVAAPSVFIFPPSDEQLKSGTASVVCLLNNFYPREAKVQWKVDNALQSGNSQESVTEQDSKDSTYSLSSTLTLSKADYEK
HKVYACEVTHQGLSSPVTKSFNRGEC

>XENP025836 1C11[PD-1]_H3.234_L3.148_IgG1_PVA_/S267K Heavy Chain (SEQ ID NOS 41299-41303)
EVQLVQSGSELKKPGESVKVSCKASGYTFT<u>HYGIN</u>WVRQFPGQGLEWMG<u>WINTYTGEPYYAPGFQE</u>RFVFSLDTSQDTAYLQINSLKAEDTAVYYCA
R<u>DYYGSSPYW</u>GQGTLVTVSS/ASTKGPSVFPLAPSSKSTSGGTAALGCLVKDYFPEPVTVSWNSGALTSGVHTFPAVLQSSGLYSLSSVVTVPSSSL
GTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNVFSCSVMHEALHNHYTQKSLSLSPGK

>XENP025836 1C11[PD-1]_H3.234_L3.148_IgG1_PVA_/S267K Light Chain (SEQ ID NOS 41304-41308)
DIVMTQSPDSLAVSLGERVTINC<u>KASQSIVHSNGNTYLE</u>WYQQKPGQAPKLLIY<u>KVSNRF</u>SGVPDRFSGSGSGTDFTLTISSVEAEDAATYYC<u>FQGS
HVPNT</u>FGQGTKVEIK/RTVAAPSVFIFPPSDEQLKSGTASVVCLLNNFYPREAKVQWKVDNALQSGNSQESVTEQDSKDSTYSLSSTLTLSKADYEK
HKVYACEVTHQGLSSPVTKSFNRGEC

>XENP025837 1C11[PD-1]_H3.239_L3.125_IgG1_PVA_/S267K Heavy Chain (SEQ ID NOS 41309-41313)
EVQLVQSGPELKKPGESVKVSCKASGYTFT<u>HYGIN</u>WVRQPPGQGLEWMG<u>WINTYTGEPYYAPGFQE</u>RFVFSIDTSQDTAYLQINSLKAEDTAVYYCA
R<u>DYYGSSPYW</u>GQGTLVTVSS/ASTKGPSVFPLAPSSKSTSGGTAALGCLVKDYFPEPVTVSWNSGALTSGVHTFPAVLQSSGLYSLSSVVTVPSSSL
GTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNVFSCSVMHEALHNHYTQKSLSLSPGK

FIG. 16H

>XENP025837 1C11[PD-1]_H3.239_L3.125_IgG1_PVA_/S267K Light Chain (SEQ ID NOS 41314-41318)
DVLMTQSPDSLAVSLGERATINCKSSQSIVHSNGNTYLEWYQQKPGQSPKLLIYKVSNRFSGVPDRFSGSGSGTDFTLTISSVEAEDVAVYYCFQGS
HVPNTFGGGTKVEIK/RTVAAPSVFIFPPSDEQLKSGTASVVCLLNNFYPREAKVQWKVDNALQSGNSQESVTEQDSKDSTYSLSSTLTLSKADYEK
HKVYACEVTHQGLSSPVTKSFNRGEC >XENP025838 1C11[PD-1]_H3.240_L3.125_IgG1_PVA_/S267K Heavy Chain (SEQ ID NOS 41319-41323)
QVQLVQSGPELKKPGESVKVSCKASGYTFTHYGINWVRQPPGQGLEWMGWINTYTGEPYYAPGFQERFVFSIDTSQDTAYLQINSLKAEDTAVYYCA
RDYYGSSPYWGQGTLVTVSS/ASTKGPSVFPLAPSSKSTSGGTAALGCLVKDYFPEPVTVSWNSGALTSGVHTFPAVLQSSGLYSLSSVVTVPSSSL
GTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNVFSCSVMHEALHNHYTQKSLSLSPGK >XENP025838 1C11[PD-1]_H3.240_L3.125_IgG1_PVA_/S267K Light Chain (SEQ ID NOS 41324-41328)
DVLMTQSPDSLAVSLGERATINCKSSQSIVHSNGNTYLEWYQQKPGQSPKLLIYKVSNRFSGVPDRFSGSGSGTDFTLTISSVEAEDVAVYYCFQGS
HVPNTFGGGTKVEIK/RTVAAPSVFIFPPSDEQLKSGTASVVCLLNNFYPREAKVQWKVDNALQSGNSQESVTEQDSKDSTYSLSSTLTLSKADYEK
HKVYACEVTHQGLSSPVTKSFNRGEC >XENP025839 1C11[PD-1]_H3.241_L3.125_IgG1_PVA_/S267K Heavy Chain (SEQ ID NOS 41329-41333)
EVQLVQSGPELKKPGESVKVSCKASGYTFTHYGINWVRQPPGQGLEWMGWINTYTGEPYYAPGFQERFVFSIDTSQDTAYLQINSLKAEDTAVYYCA
RDYYGSSPYWGQGTLVTVSS/ASTKGPSVFPLAPSSKSTSGGTAALGCLVKDYFPEPVTVSWNSGVHTFPAVLQSSGLYSLSSVVTVPSSSL
GTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNVFSCSVMHEALHNHYTQKSLSLSPGK >XENP025839 1C11[PD-1]_H3.241_L3.125_IgG1_PVA_/S267K Light Chain (SEQ ID NOS 41334-41338)
DVLMTQSPDSLAVSLGERATINCKSSQSIVHSNGNTYLEWYQQKPGQSPKLLIYKVSNRFSGVPDRFSGSGSGTDFTLTISSVEAEDVAVYYCFQGS
HVPNTFGGGTKVEIK/RTVAAPSVFIFPPSDEQLKSGTASVVCLLNNFYPREAKVQWKVDNALQSGNSQESVTEQDSKDSTYSLSSTLTLSKADYEK
HKVYACEVTHQGLSSPVTKSFNRGEC >XENP025840 1C11[PD-1]_H3.239_L3.92_IgG1_PVA_/S267K Heavy Chain (SEQ ID NOS 41339-41343)
EVQLVQSGPELKKPGESVKVSCKASGYTFTHYGINWVRQPPGQGLEWMGWINTYTGEPYYAPGFQERFVFSIDTSQDTAYLQINSLKAEDTAVYYCA
RDYYGSSPYWGQGTLVTVSS/ASTKGPSVFPLAPSSKSTSGGTAALGCLVKDYFPEPVTVSWNSGALTSGVHTFPAVLQSSGLYSLSSVVTVPSSSL
GTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNVFSCSVMHEALHNHYTQKSLSLSPGK >XENP025840 1C11[PD-1]_H3.239_L3.92_IgG1_PVA_/S267K Light Chain (SEQ ID NOS 41344-41348)
DIVMTQSPDSLAVSLGERVTINCKASQSIVHSNGNTYLEWYQQKPGQPPKLLIYKVSNRFTGVPDRFSGSGSGTDFTLTISSLQAEDVAVYYCFQGS
HVPNTFGGGTKVEIK/RTVAAPSVFIFPPSDEQLKSGTASVVCLLNNFYPREAKVQWKVDNALQSGNSQESVTEQDSKDSTYSLSSTLTLSKADYEK
HKVYACEVTHQGLSSPVTKSFNRGEC >XENP025841 1C11[PD-1]_H3.240_L3.92_IgG1_PVA_/S267K Heavy Chain (SEQ ID NOS 41349-41353)
QVQLVQSGPELKKPGESVKVSCKASGYTFTHYGINWVRQPPGQGLEWMGWINTYTGEPYYAPGFQERFVFSIDTSQDTAYLQINSLKAEDTAVYYCA
RDYYGSSPYWGQGTLVTVSS/ASTKGPSVFPLAPSSKSTSGGTAALGCLVKDYFPEPVTVSWNSGALTSGVHTFPAVLQSSGLYSLSSVVTVPSSSL
GTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNVFSCSVMHEALHNHYTQKSLSLSPGK >XENP025841 1C11[PD-1]_H3.240_L3.92_IgG1_PVA_/S267K Light Chain (SEQ ID NOS 41354-41358)
DIVMTQSPDSLAVSLGERVTINCKASQSIVHSNGNTYLEWYQQKPGQPPKLLIYKVSNRFTGVPDRFSGSGSGTDFTLTISSLQAEDVAVYYCFQGS
HVPNTFGGGTKVEIK/RTVAAPSVFIFPPSDEQLKSGTASVVCLLNNFYPREAKVQWKVDNALQSGNSQESVTEQDSKDSTYSLSSTLTLSKADYEK
HKVYACEVTHQGLSSPVTKSFNRGEC >XENP025842 1C11[PD-1]_H3.241_L3.92_IgG1_PVA_/S267K Heavy Chain (SEQ ID NOS 41359-41363)
EVQLVQSGPELKKPGESVKVSCKASGYTFTHYGINWVRQPPGQGLEWMGWINTYTGEPYYAPGFQERFVFSIDTSQDTAYLQINSLKAEDTAVYYCA
RDYYGSSPYWGQGTLVTVSS/ASTKGPSVFPLAPSSKSTSGGTAALGCLVKDYFPEPVTVSWNSGALTSGVHTFPAVLQSSGLYSLSSVVTVPSSSL
GTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLTCLVKGFYPSDIAVEWESNGQPE
NNYKTTPPVLDSDGSFFLYSKLTVDKSRWQQGNVFSCSVMHEALHNHYTQKSLSLSPGK >XENP025842 1C11[PD-1]_H3.241_L3.92_IgG1_PVA_/S267K Light Chain (SEQ ID NOS 41364-41368)
DIVMTQSPDSLAVSLGERVTINCKASQSIVHSNGNTYLEWYQQKPGQPPKLLIYKVSNRFTGVPDRFSGSGSGTDFTLTISSLQAEDVAVYYCFQGS
HVPNTFGGGTKVEIK/RTVAAPSVFIFPPSDEQLKSGTASVVCLLNNFYPREAKVQWKVDNALQSGNSQESVTEQDSKDSTYSLSSTLTLSKADYEK
HKVYACEVTHQGLSSPVTKSFNRGEC

FIG. 17A

| XENP | Variant Name | K$_D$ (M) | k$_a$ (1/Ms) | k$_d$ (1/s) | VH Variants | VL Variants | T$_m$ (°C) |
|---|---|---|---|---|---|---|---|
| 22538 (22553) | 1C11_H3_L3 | 1.84E-08 | 2.14E+05 | 3.93E-03 | | | 53.5 |
| 23577 | 1C11_H3_L3.1 | 9.95E-09 | 2.40E+05 | 2.38E-03 | | V2I | 53.5 |
| 23579 | 1C11_H3_L3.3 | 1.54E-08 | 1.74E+05 | 2.68E-03 | | L3V | 54.5 |
| 23589 | 1C11_H3_L3.15 | 1.50E-08 | 2.45E+05 | 3.67E-03 | | A12S | 53.5 |
| 23601 | 1C11_H3_L3.23 | 3.87E-08 | 1.26E+05 | 4.90E-03 | | A19V | 54 |
| 23605 | 1C11_H3_L3.28 | 1.57E-08 | 2.16E+05 | 3.39E-03 | | K24R | 53.5 |
| 23609 | 1C11_H3_L3.32 | 2.20E-08 | 2.90E+05 | 6.37E-03 | | S25A | 54 |
| 24201 | 1C11_H3_L3.113 | 1.98E-08 | 1.98E+05 | 3.92E-03 | | Q48K | 54 |
| 23615 | 1C11_H3_L3.46 | 1.88E-08 | 2.51E+05 | 4.73E-03 | | S49P | 54 |
| 23616 | 1C11_H3_L3.47 | 1.21E-08 | 4.26E+05 | 5.14E-03 | | S49A | 54 |
| 23624 | 1C11_H3_L3.57 | 1.45E-08 | 2.55E+05 | 3.68E-03 | | S62T | 53.5 |
| 24207 | 1C11_H3_L3.122 | 1.16E-09 | 5.68E+05 | 6.61E-04 | | V64I | 53.5 |
| 24208 | 1C11_H3_L3.124 | 1.62E-08 | 1.80E+05 | 2.92E-03 | | D66A | 53.5 |
| 23626 | 1C11_H3_L3.59 | 1.03E-08 | 3.41E+05 | 3.52E-03 | | S83R | 53 |
| 23628 | 1C11_H3_L3.62 | 1.55E-08 | 1.68E+05 | 2.60E-03 | | L84M | 54 |
| 23629 | 1C11_H3_L3.63 | 4.51E-08 | 9.98E+04 | 4.50E-03 | | L84V | 55 |
| 24209 | 1C11_H3_L3.125 | 6.81E-09 | 3.50E+05 | 2.38E-03 | | L84V Q85E | 54.5 |
| 23633 | 1C11_H3_L3.69 | 3.38E-08 | 2.04E+05 | 6.91E-03 | | V89A | 54 |
| 23636 | 1C11_H3_L3.73 | 1.19E-08 | 2.22E+05 | 2.65E-03 | | V91T | 54 |
| 23640 | 1C11_H3_L3.81 | 2.33E-08 | 1.51E+05 | 3.52E-03 | | G108Q | 54 |
| 24210 | 1C11_H3_L3.132 | 1.63E-08 | 1.81E+05 | 2.95E-03 | | G108P | 53.5 |
| 24372 | 1C11_H3_L3.86 | 1.94E-08 | 2.06E+05 | 3.98E-03 | | S62T L84V V91T G108Q | 55.5 |
| 24373 | 1C11_H3_L3.87 | 2.17E-08 | 1.60E+05 | 3.48E-03 | | L3V A19V S25A S49P | 56 |
| 24374 | 1C11_H3_L3.90 | 2.50E-08 | 1.70E+05 | 4.26E-03 | | L3V S25A S49P L84V V89A V91T G108Q | 57 |
| 24375 | 1C11_H3_L3.92 | 1.89E-08 | 1.70E+05 | 3.22E-03 | | V2I L3V A19V S25A S49P S62T | 56 |
| 24376 | 1C11_H3_L3.94 | 1.85E-08 | 1.77E+05 | 3.27E-03 | | V2I S62T L84V V89A V91T G108Q | 56 |

FIG. 17B

| XENP | Variant Name | K$_D$ (M) | k$_a$ (1/Ms) | k$_d$ (1/s) | VH Variants | VL Variants | T$_m$ (°C) |
|---|---|---|---|---|---|---|---|
| 24377 | 1C11_H3_L3.96 | 2.65E-08 | 1.63E+05 | 4.33E-03 | | V2I L3V S25A S49P S62T L84V V89A V91T G108Q | 57.5 |
| 24378 | 1C11_H3_L3.105 | 2.04E-08 | 1.88E+05 | 3.85E-03 | | A12P S14T L15P R18P | 71.5 |
| 24379 | 1C11_H3_L3.129 | | | | | S82N V89A V91T F95H | 49.5 |
| 24380 | 1C11_H3.176_L3.92 | | | | D66P T69K | V2I L3V A19V S25A S49P S62T | 59 |
| 24381 | 1C11_H3.176_L3.94 | | | | D66P T69K | V2I S62T L84V V89A V91T G108Q | 60 |
| 24382 | 1C11_H3.176_L3.96 | | | | D66P T69K | V2I L3V S25A S49P S62T L84V V89A V91T G108Q | 62 |
| 24414 | 1C11_H3_L3.133 | | | | | L3V A19V S25A S49P L84V V89A V91T G108Q | 58.5 |
| 24415 | 1C11_H3_L3.134 | | | | | L3V A19V S25A S49P L84V Q85E V89A V91T G108Q | 58 |
| 24416 | 1C11_H3_L3.135 | | | | | L3V A19V S25A S49P L84M V89A V91T G108Q | 57.5 |
| 24417 | 1C11_H3_L3.136 | | | | | L3V A19I S25A S49P L84M V89A V91T G108Q | 57 |

FIG. 17C

| XENP | Variant Name | K_D (M) | k_a (1/Ms) | k_d (1/s) | VH Variants | VL Variants | Tm (°C) |
|---|---|---|---|---|---|---|---|
| 24418 | 1C11_H3_L3.137 | | | | | L3V A19I S25A S49P L84V V89A V91T G108Q | 58 |
| 24419 | 1C11_H3_L3.138 | | | | | L3V A19I S25A S49P L84V Q85E V89A V91T G108Q | 58 |
| 24420 | 1C11_H3_L3.139 | | | | | L3V S25A S49P V64I L84V V89A V91T G108Q | 57.5 |
| 24421 | 1C11_H3_L3.140 | | | | | V2I L3V S25A L84V Q85E V91T G108Q | 56 |
| 24422 | 1C11_H3_L3.141 | 3.37E-08 | 2.63E+05 | 8.87E-03 | | V2I L3V S25A S49P L84V Q85E V91T G108Q | 57 |
| 24423 | 1C11_H3_L3.142 | 3.55E-08 | 2.50E+05 | 8.86E-03 | | V2I L3V S25A S49A L84V Q85E V91T G108Q | 57 |
| 24422 | 1C11_H3_L3.141 | | | | | V2I L3V S25A S49P L84V Q85E V91T G108Q | 56.5 |
| 24853 | 1C11_H3_L3.143 | | | | | V2I L3V A19V S25A S49P L84V Q85E V91T G108Q | 57.5 |
| 24854 | 1C11_H3_L3.144 | | | | | V2I L3V A19V S25A S49P L84V Q85E V89A V91T G108Q | 58.5 |

FIG. 17D

| XENP | Variant Name | K$_D$ (M) | k$_a$ (1/Ms) | k$_d$ (1/s) | VH Variants | VL Variants | T$_m$ (°C) |
|---|---|---|---|---|---|---|---|
| 24855 | 1C11_H3_L3.145 | | | | | V2I L3V A19V S25A L84V Q85E V91T G108Q | 56.5 |
| 24856 | 1C11_H3_L3.146 | | | | | V2I L3V A19V S25A L84V Q85E V89A V91T G108Q | 57.5 |
| 24857 | 1C11_H3_L3.147 | | | | | V2I L3V A19V S25A S49A L84V Q85E V91T G108Q | 57 |
| 24858 | 1C11_H3_L3.148 | | | | | V2I L3V A19V S25A S49A L84V Q85E V89A V91T G108Q | 58 |
| 24218 | 1C11_H3.86_L3 | 1.90E-08 | 1.64E+05 | 3.12E-03 | Q1E | | |
| 23755 | 1C11_H3.1_L3 | 2.42E-08 | 1.57E+05 | 3.80E-03 | I2V | | |
| 23758 | 1C11_H3.5_L3 | 1.91E-08 | 2.48E+05 | 4.73E-03 | S9A | | |
| 23760 | 1C11_H3.7_L3 | 4.19E-08 | 1.76E+05 | 7.37E-03 | S9P | | |
| 24221 | 1C11_H3.90_L3 | 2.53E-08 | 1.68E+05 | 4.24E-03 | E10V | | |
| 24222 | 1C11_H3.91_L3 | 2.47E-08 | 1.72E+05 | 4.26E-03 | K12V | | |
| 24226 | 1C11_H3.95_L3 | 2.00E-08 | 1.92E+05 | 3.84E-03 | A16G | | |
| 24227 | 1C11_H3.96_L3 | 2.30E-08 | 1.74E+05 | 4.00E-03 | A16Q | | |
| 24228 | 1C11_H3.97_L3 | 2.42E-08 | 1.87E+05 | 4.52E-03 | A16E | | |
| 24247 | 1C11_H3.120_L3 | 2.14E-08 | 2.02E+05 | 4.32E-03 | M36I | | |
| 23765 | 1C11_H3.18_L3 | 1.56E-08 | 1.51E+05 | 2.35E-03 | R40K | | |
| 24250 | 1C11_H3.125_L3 | 1.80E-08 | 2.04E+05 | 3.66E-03 | A42P | | |
| 24254 | 1C11_H3.129_L3 | 2.37E-08 | 3.03E+05 | 7.19E-03 | M50I | | |
| 24256 | 1C11_H3.134_L3 | 2.17E-08 | 2.48E+05 | 5.38E-03 | Y56K | | |
| 23770 | 1C11_H3.25_L3 | 3.40E-08 | 1.84E+05 | 6.25E-03 | Y56N | | |
| 24263 | 1C11_H3.143_L3 | 3.19E-08 | 2.02E+05 | 6.46E-03 | T63Y | | |
| 24266 | 1C11_H3.146_L3 | 2.30E-08 | 2.20E+05 | 5.06E-03 | D66P | | |
| 24267 | 1C11_H3.147_L3 | 2.04E-08 | 2.22E+05 | 4.52E-03 | D66T | | |
| 24268 | 1C11_H3.148_L3 | 2.26E-08 | 1.89E+05 | 4.26E-03 | D66Q G67K | | |
| 23776 | 1C11_H3.35_L3 | 6.92E-08 | 6.25E+04 | 4.32E-03 | G67K | | |
| 23779 | 1C11_H3.41_L3 | 3.44E-08 | 1.04E+05 | 3.57E-03 | T69K | | |
| 23780 | 1C11_H3.42_L3 | 2.78E-08 | 1.09E+05 | 3.04E-03 | T69Q | | |

FIG. 17E

| XENP | Variant Name | K$_D$ (M) | k$_a$ (1/Ms) | k$_d$ (1/s) | VH Variants | VL Variants | T$_m$ (°C) |
|---|---|---|---|---|---|---|---|
| 24270 | 1C11_H3.150_L3 | 1.89E-08 | 2.02E+05 | 3.81E-03 | G70E | | |
| 23781 | 1C11_H3.43_L3 | 1.60E-08 | 2.42E+05 | 3.89E-03 | F72V | | |
| 23786 | 1C11_H3.50_L3 | 1.80E-08 | 1.40E+05 | 2.52E-03 | L76V | | |
| 24274 | 1C11_H3.154_L3 | 2.24E-08 | 1.99E+05 | 4.46E-03 | L76I | | |
| 23793 | 1C11_H3.59_L3 | 9.74E-09 | 4.40E+05 | 4.28E-03 | V80Q | | |
| 24279 | 1C11_H3.159_L3 | 2.29E-08 | 2.39E+05 | 5.45E-03 | S81D | | |
| 24278 | 1C11_H3.158_L3 | 1.59E-08 | 2.19E+05 | 3.48E-03 | S81N | | |
| 23796 | 1C11_H3.62_L3 | 1.62E-08 | 3.90E+05 | 6.32E-03 | A83I | | |
| 24287 | 1C11_H3.168_L3 | 2.25E-08 | 1.96E+05 | 4.40E-03 | S88N | | |
| 24291 | 1C11_H3.172_L3 | 2.41E-08 | 2.10E+05 | 5.06E-03 | A92P | | |
| 23811 | 1C11_H3.74_L3 | 3.90E-08 | 2.00E+05 | 7.82E-03 | F99Y | | |
| 24211 | 1C11_H3.78_L3 | 4.75E-08 | 2.37E+05 | 1.13E-02 | S9P Y56N L76V V80Q | | |
| 24212 | 1C11_H3.80_L3 | 3.88E-08 | 2.64E+05 | 1.02E-02 | Y56N L76V V80Q F99Y | | |
| 24213 | 1C11_H3.81_L3 | 2.22E-08 | 1.94E+05 | 4.30E-03 | G67K T69K | | |
| 24214 | 1C11_H3.82_L3 | 1.60E-08 | 1.98E+05 | 3.16E-03 | G67K T69Q | | |
| 24215 | 1C11_H3.83_L3 | 3.57E-08 | 2.71E+05 | 9.67E-03 | Y56N L76V V80Q | | |
| 24216 | 1C11_H3.84_L3 | 2.01E-08 | 1.78E+05 | 3.59E-03 | G67K T69K V80Q | | |
| 24217 | 1C11_H3.85_L3 | 1.78E-08 | 1.92E+05 | 3.41E-03 | G67K T69Q V80Q | | |
| 24424 | 1C11_H3.176_L3 | | | | D66P T69K | | 58 |
| 24425 | 1C11_H3.177_L3 | | | | D66P G67K | | 58.5 |
| 24426 | 1C11_H3.178_L3 | | | | D66P T69K G70E | | 59 |
| 24427 | 1C11_H3.179_L3 | | | | D66P G67K G70E | | 58.5 |
| 24428 | 1C11_H3.180_L3 | | | | M36I L76V | | 55.5 |
| 24429 | 1C11_H3.181_L3 | | | | M36I L76I | | 55.5 |
| 24430 | 1C11_H3.182_L3 | | | | K12V A16E | | 54 |
| 24431 | 1C11_H3.183_L3 | | | | E10V A16E | | 56 |
| 24432 | 1C11_H3.184_L3 | | | | E10V K12V A16E | | 55.5 |
| 24433 | 1C11_H3.185_L3 | | | | Q1E I2V K12V A16E M36I A42P M50I T63Y D66P G67K G70E V80Q S81D S88N F99Y | | 61 |

FIG. 17F

| XENP | Variant Name | K$_D$ (M) | k$_a$ (1/Ms) | k$_d$ (1/s) | VH Variants | VL Variants | T$_m$ (°C) |
|---|---|---|---|---|---|---|---|
| 24434 | 1C11_H3.186_L3 | | | | Q1E I2V K12V A16E M36I A42P T63Y D66P G70E S81D S88N F99Y | | 61.5 |
| 24435 | 1C11_H3.187_L3 | | | | I2V K12V A16E M36I A42P T63Y D66P G70E V80Q S88N F99Y | | 62 |
| 24436 | 1C11_H3.188_L3 | 5.32E-08 | 3.20E+05 | 1.71E-02 | I2V A16E M36I A42P M50I T63Y D66P V80Q S88N F99Y | | 62.5 |
| 24437 | 1C11_H3.189_L3 | | | | I2V M36I A42P M50I T63Y D66P G67K S88N F99Y | | 61 |
| 24438 | 1C11_H3.190_L3 | | | | I2V E10V A16G M36I A42P M50I T63Y D66P V80Q S88N F99Y | | 60.5 |
| 24439 | 1C11_H3.191_L3 | | | | I2V K12V A16E D66P V80Q S88N | | 58.5 |
| 24440 | 1C11_H3.192_L3 | | | | Q1E I2V E10V A16E M36I G70E | | 58 |
| 24441 | 1C11_H3.193_L3 | | | | A42P M50I D66P G70E V80Q S88N F99Y | | 59.5 |
| 24442 | 1C11_H3.194_L3 | | | | Q1E E10V M36I M50I | | 56 |

FIG. 17G

| XENP | Variant Name | K_D (M) | k_a (1/Ms) | k_d (1/s) | VH Variants | VL Variants | T_m (°C) |
|---|---|---|---|---|---|---|---|
| 24443 | 1C11_H3.195_L3 | | | | A42P T63Y S81D S88N | | 55 |
| 24436 | 1C11_H3.188_L3 | | | | I2V A16E M36I A42P M50I T63Y D66P V80Q S88N F99Y | | 61.5 |
| 24827 | 1C11_H3.196_L3 | | | | Q1E I2V A16E M36I A42P M50I T63Y D66P V80Q S88N F99Y | | 61 |
| 24828 | 1C11_H3.197_L3 | | | | I2V M36I A42P M50I T63Y D66P V80Q S88N F99Y | | 60 |
| 24829 | 1C11_H3.198_L3 | | | | I2V A16E M36I A42P M50I T63Y V80Q S88N F99Y | | 59 |
| 24830 | 1C11_H3.199_L3 | | | | I2V A16E A42P M50I T63Y D66P V80Q S88N F99Y | | 60.5 |
| 24831 | 1C11_H3.200_L3 | | | | I2V A16E M36I A42P M50I T63Y D66P V80Q S88N | | 61 |
| 24832 | 1C11_H3.201_L3 | | | | I2V A16E M36I A42P M50I T63Y D66P L76I V80Q S88N F99Y | | 62 |
| 24833 | 1C11_H3.202_L3 | | | | I2V A16E M36I M50I T63Y D66P V80Q S88N F99Y | | 61.5 |

FIG. 17H

| XENP | Variant Name | K$_D$ (M) | k$_a$ (1/Ms) | k$_d$ (1/s) | VH Variants | VL Variants | T$_m$ (°C) |
|---|---|---|---|---|---|---|---|
| 24834 | 1C11_H3.203_L3 | | | | I2V A16E M36I A42P M50I T63Y D66P G70E V80Q S88N F99Y | | 62.5 |
| 24835 | 1C11_H3.204_L3 | | | | I2V A16E M36I A42P M50I T63Y D66P T69Q V80Q S88N F99Y | | 62.5 |
| 24836 | 1C11_H3.205_L3 | | | | I2V A16E M36I A42P M50I T63Y D66P T69K V80Q S88N F99Y | | 62.5 |
| 24837 | 1C11_H3.206_L3 | | | | I2V A16E M36I A42P M50I D66P V80Q S88N F99Y | | 62 |
| 24838 | 1C11_H3.207_L3 | | | | I2V A16E M36I A42P M50I T63Y D66P V80Q F99Y | | 61.5 |
| 24839 | 1C11_H3.208_L3 | | | | I2V A16E M36I A42P M50I T63Y D66P V80Q S81D S88N F99Y | | 61.5 |
| 24840 | 1C11_H3.209_L3 | | | | I2V A16E M36I A42P T63Y D66P V80Q S88N F99Y | | 63 |
| 24841 | 1C11_H3.210_L3 | | | | I2V A16E M36I A42P M50I T63Y D66P S88N F99Y | | 61.5 |

FIG. 17I

| XENP | Variant Name | K^D (M) | k_a (1/Ms) | k_d (1/s) | VH Variants | VL Variants | T_m (°C) |
|---|---|---|---|---|---|---|---|
| 24842 | 1C11_H3.211_L3 | | | | I2V S9P A16E M36I A42P M50I T63Y D66P V80Q S88N F99Y | | 63.5 |
| 24843 | 1C11_H3.212_L3 | | | | I2V A16E M36I A42P M50I T63Y D66P S81D S88N F99Y | | 61 |
| 24844 | 1C11_H3.213_L3 | | | | I2V S9P A16E M36I M50I T63Y D66P V80Q S81D S88N F99Y | | 62.5 |
| 24845 | 1C11_H3.214_L3 | | | | I2V S9P A16E M36I M50I T63Y D66P L76I V80Q S88N F99Y | | 62.5 |
| 24846 | 1C11_H3.215_L3 | | | | I2V S9P A16E M36I M50I T63Y D66P S88N F99Y | | 62.5 |
| 24847 | 1C11_H3.216_L3 | | | | I2V S9P A16E M36I A42P T63Y D66P L76I V80Q S88N F99Y | | 65.5 |
| 24848 | 1C11_H3.217_L3 | | | | I2V S9P A16E M36I A42P T63Y D66P S88N F99Y | | 64 |
| 24849 | 1C11_H3.218_L3 | | | | I2V S9P A16E M36I A42P T63Y D66P V80Q S81D S88N F99Y | | 63.5 |

FIG. 17J

| XENP | Variant Name | K$_D$ (M) | k$_a$ (1/Ms) | k$_d$ (1/s) | VH Variants | VL Variants | T$_m$ (°C) |
|---|---|---|---|---|---|---|---|
| 24850 | 1C11_H3.219_L3 | | | | I2V A16E M36I A42P M50I T63Y D66P T69Q G70E V80Q S88N F99Y | | 63 |
| 24851 | 1C11_H3.220_L3 | | | | I2V A16E M36I A42P M50I T63Y D66P T69K G70E V80Q S88N F99Y | | 62.5 |
| 24852 | 1C11_H3.221_L3 | | | | Q1E A16E M36I A42P M50I T63Y D66P V80Q S88N F99Y | | |
| 25295 | 1C11_H3.222_L3 | | | | I2V S9P A16E M36I A42P D66P L76I V80Q S88N F99Y | | 64 |
| 25296 (25322) | 1C11_H3.223_L3 | 3.21E-08 | | | I2V S9P A16E M36I A42P T63Y D66P G70E L76I V80Q S88N F99Y | | 67 |
| 25301 (25323) | 1C11_H3.224_L3 | 3.06E-08 | | | I2V S9P A16E M36I A42P T63Y D66P T69Q G70E L76I V80Q S88N F99Y | | 67 |
| 25302 (25324) | 1C11_H3.225_L3 | 3.22E-08 | | | I2V S9P A16E M36I T63Y D66P G70E V80Q S81D S88N F99Y | | 64.5 |
| 25303 (25325) | 1C11_H3.226_L3 | 3.35E-08 | | | I2V S9P A16E M36I T63Y D66P T69Q G70E V80Q S81D S88N F99Y | | 64.5 |

FIG. 17K

| XENP | Variant Name | K_D (M) | k_a (1/Ms) | k_d (1/s) | VH Variants | VL Variants | T_m (°C) |
|---|---|---|---|---|---|---|---|
| 25304 | 1C11_H3.227_L3 | | | | Q1E I2V S9P A16E M36I T63Y D66P G70E V80Q S81D S88N F99Y | | 64.5 |
| 25305 | 1C11_H3.228_L3 | | | | Q1E I2V S9P A16E M36I T63Y D66P T69Q G70E V80Q S81D S88N F99Y | | 65 |
| 25306 (25326) | 1C11_H3.229_L3 | 3.79E-08 | | | I2V A16E M36I A42P T63Y D66P T69Q G70E V80Q S88N F99Y | | 64.5 |
| 25307 (25327) | 1C11_H3.230_L3 | 4.19E-08 | | | I2V A16E M36I A42P T63Y D66P T69Q G70E V80Q S81D S88N F99Y | | 64 |
| 25308 (25328) | 1C11_H3.231_L3 | 3.01E-08 | | | I2V A16E M36I A42P D66P V80Q F99Y | | 61.5 |
| 25309 (25329) | 1C11_H3.232_L3 | 3.32E-08 | | | I2V A16E M36I A42P D66P V80Q S81D S88N F99Y | | 61.5 |
| 25310 | 1C11_H3.233_L3 | | | | Q1E I2V A16E M36I A42P T63Y D66P T69Q G70E V80Q S88N F99Y | | 64.5 |
| 25311 | 1C11_H3.234_L3 | | | | Q1E I2V A16E M36I A42P T63Y D66P T69Q G70E V80Q S81D S88N F99Y | | 63.5 |

FIG. 17L

| XENP | Variant Name | K_D (M) | k_a (1/Ms) | k_d (1/s) | VH Variants | VL Variants | T_m (°C) |
|---|---|---|---|---|---|---|---|
| 25312 (25330) | 1C11_H3.235_L3 | 3.14E-08 | | | Q1E I2V A16E M36I A42P D66P V80Q F99Y | | 61.5 |
| 25313 (25331) | 1C11_H3.236_L3 | 3.94E-08 | | | Q1E I2V A16E M36I A42P D66P V80Q S81D S88N F99Y | | 61.5 |
| 25314 (25332) | 1C11_H3.237_L3 | 3.44E-08 | | | I2V A16E M36I T63Y D66P G70E V80Q S81D S88N F99Y | | 63 |
| 25315 (25333) | 1C11_H3.238_L3 | 3.84E-08 | | | I2V A16E M36I T63Y D66P T69Q G70E V80Q S81D S88N F99Y | | 63.5 |
| 25316 | 1C11_H3.213_L3.144 | | | | I2V S9P A16E M36I M50I T63Y D66P V80Q S81D S88N F99Y | | 60, 71.5 |
| 25317 | 1C11_H3.213_L3.148 | | | | I2V S9P A16E M36I M50I T63Y D66P V80Q S81D S88N F99Y | | 59.5, 70.5 |
| 25318 | 1C11_H3.216_L3.144 | | | | I2V S9P A16E M36I A42P T63Y D66P L76I V80Q S88N F99Y | | 73 |
| 25319 | 1C11_H3.216_L3.148 | | | | I2V S9P A16E M36I A42P T63Y D66P L76I V80Q S88N F99Y | | 72.5 |

FIG. 17M

| XENP | Variant Name | K_D (M) | k_a (1/Ms) | k_d (1/s) | VH Variants | VL Variants | T_m (°C) |
|---|---|---|---|---|---|---|---|
| 25320 (25334) | 1C11_H3.188_L3.144 | 5.04E-08 | | | I2V A16E M36I A42P M50I T63Y D66P V80Q S88N F99Y | V2I L3V A19V S25A S49P L84V Q85E V89A V91T G108Q | 60, 71 |
| 25321 (25335) | 1C11_H3.188_L3.148 | 4.13E-08 | | | I2V A16E M36I A42P M50I T63Y D66P V80Q S88N F99Y | V2I L3V A19V S25A S49A L84V Q85E V89A V91T G108Q | 59.5, 70.5 |
| 25802 (25336) | 1C11_H3.224_L3.144 | 3.31E-08 | | | I2V S9P A16E M36I A42P T63Y D66P T69Q G70E L76I V80Q S88N F99Y | V2I L3V A19V S25A S49P L84V Q85E V89A V91T G108Q | |
| 25803 (25337) | 1C11_H3.224_L3.148 | 3.12E-08 | | | I2V S9P A16E M36I A42P T63Y D66P T69Q G70E L76I V80Q S88N F99Y | V2I L3V A19V S25A S49A L84V Q85E V89A V91T G108Q | |
| (25338) | 1C11_H3.226_L3.144 | 4.37E-08 | | | I2V S9P A16E M36I T63Y D66P T69Q G70E V80Q S81D S88N F99Y | V2I L3V A19V S25A S49P L84V Q85E V89A V91T G108Q | |
| (25339) | 1C11_H3.226_L3.148 | 4.18E-08 | | | I2V S9P A16E M36I T63Y D66P T69Q G70E V80Q S81D S88N F99Y | V2I L3V A19V S25A S49A L84V Q85E V89A V91T G108Q | |
| 24436 (25340) | 1C11_H3.188_L3 | 5.32E-08 | | | I2V A16E M36I A42P M50I T63Y D66P V80Q S88N F99Y | | |
| 24422 (25341) | 1C11_H3_L3.141 | 3.37E-08 | | | | V2I L3V S25A S49P L84V Q85E V91T G108Q | |

FIG. 17N

| XENP | Variant Name | K$_D$ (M) | k$_a$ (1/Ms) | k$_d$ (1/s) | VH Variants | VL Variants | T$_m$ (°C) |
|---|---|---|---|---|---|---|---|
| 24423 (25342) | 1C11_H3_L3.142 | 3.55E-08 | | | | V2I L3V S25A S49A L84V Q85E V91T G108Q | |
| 25802 (25336) | 1C11_H3.224_L3.144 | 3.31E-08 | | | I2V S9P A16E M36I A42P T63Y D66P T69Q G70E L76I V80Q S88N F99Y | V2I L3V A19V S25A S49P L84V Q85E V89A V91T G108Q | 74 |
| 25803 (25337) | 1C11_H3.224_L3.148 | 3.12E-08 | | | I2V S9P A16E M36I A42P T63Y D66P T69Q G70E L76I V80Q S88N F99Y | V2I L3V A19V S25A S49A L84V Q85E V89A V91T G108Q | 73.5 |
| 25804 (25833) | 1C11_H3.228_L3.144 | 3.88E-08 | 2.59E+05 | 1.00E-02 | Q1E I2V S9P A16E M36I T63Y D66P T69Q G70E V80Q S81D S88N F99Y | V2I L3V A19V S25A S49P L84V Q85E V89A V91T G108Q | 62, 72.5 |
| 25805 (25834) | 1C11_H3.228_L3.148 | 4.19E-08 | 2.37E+05 | 9.94E-03 | Q1E I2V S9P A16E M36I T63Y D66P T69Q G70E V80Q S81D S88N F99Y | V2I L3V A19V S25A S49A L84V Q85E V89A V91T G108Q | 62, 72 |
| 25806 (25835) | 1C11_H3.234_L3.144 | 2.74E-08 | 2.83E+05 | 7.75E-03 | Q1E I2V A16E M36I A42P T63Y D66P T69Q G70E V80Q S81D S88N F99Y | V2I L3V A19V S25A S49P L84V Q85E V89A V91T G108Q | 60.5, 71.5 |
| 25807 (25836) | 1C11_H3.234_L3.148 | 3.75E-08 | 2.32E+05 | 8.69E-03 | Q1E I2V A16E M36I A42P T63Y D66P T69Q G70E V80Q S81D S88N F99Y | V2I L3V A19V S25A S49A L84V Q85E V89A V91T G108Q | 60.5, 71 |

FIG. 17O

| XENP | Variant Name | K$_D$ (M) | k$_a$ (1/Ms) | k$_d$ (1/s) | VH Variants | VL Variants | T$_m$ (°C) |
|---|---|---|---|---|---|---|---|
| 25808 (25825) | 1C11_H3.239_L3.144 | 4.26E-08 | 2.19E+05 | 9.34E-03 | Q1E I2V S9P A16E M36I A42P T63Y D66P T69Q G70E L76I V80Q S88N F99Y | V2I L3V A19V S25A S49P L84V Q85E V89A V91T G108Q | 74 |
| 25809 (25826) | 1C11_H3.240_L3.144 | 4.31E-08 | 2.43E+05 | 1.05E-02 | I2V S9P A16E M36I A42P T63Y D66P T69Q G70E L76I V80Q S81D S88N F99Y | V2I L3V A19V S25A S49P L84V Q85E V89A V91T G108Q | 73.5 |
| 25810 (25827) | 1C11_H3.241_L3.144 | 4.05E-08 | 2.18E+05 | 8.84E-03 | Q1E I2V S9P A16E M36I A42P T63Y D66P T69Q G70E L76I V80Q S81D S88N F99Y | V2I L3V A19V S25A S49P L84V Q85E V89A V91T G108Q | 73.5 |
| 25811 (25828) | 1C11_H3.239_L3.148 | 4.47E-08 | 2.27E+05 | 1.02E-02 | Q1E I2V S9P A16E M36I A42P T63Y D66P T69Q G70E L76I V80Q S88N F99Y | V2I L3V A19V S25A S49A L84V Q85E V89A V91T G108Q | 73.5 |
| 25812 (25829) | 1C11_H3.240_L3.148 | 2.75E-08 | 3.22E+05 | 8.85E-03 | I2V S9P A16E M36I A42P T63Y D66P T69Q G70E L76I V80Q S81D S88N F99Y | V2I L3V A19V S25A S49A L84V Q85E V89A V91T G108Q | 72.5 |
| 25813 (25830) | 1C11_H3.241_L3.148 | 3.33E-08 | 2.86E+05 | 9.53E-03 | Q1E I2V S9P A16E M36I A42P T63Y D66P T69Q G70E L76I V80Q S81D S88N F99Y | V2I L3V A19V S25A S49A L84V Q85E V89A V91T G108Q | 72.5 |

FIG. 17P

| XENP | Variant Name | K$_D$ (M) | k$_a$ (1/Ms) | k$_d$ (1/s) | VH Variants | VL Variants | T$_m$ (°C) |
|---|---|---|---|---|---|---|---|
| 25814 (25837) | 1C11_H3.239_L3.125 | 4.16E-08 | 3.15E+05 | 1.31E-02 | Q1E I2V S9P A16E M36I A42P T63Y D66P T69Q G70E L76I V80Q S88N F99Y | L84V Q85E | 68 |
| 25815 (25838) | 1C11_H3.240_L3.125 | 5.08E-08 | 2.80E+05 | 1.42E-02 | I2V S9P A16E M36I A42P T63Y D66P T69Q G70E L76I V80Q S81D S88N F99Y | L84V Q85E | 67 |
| 25816 (25839) | 1C11_H3.241_L3.125 | 4.34E-08 | 3.34E+05 | 1.45E-02 | Q1E I2V S9P A16E M36I A42P T63Y D66P T69Q G70E L76I V80Q S81D S88N F99Y | L84V Q85E | 67 |
| 25817 (25840) | 1C11_H3.239_L3.92 | 3.46E-08 | 2.66E+05 | 9.22E-03 | Q1E I2V S9P A16E M36I A42P T63Y D66P T69Q G70E L76I V80Q S88N F99Y | V2I L3V A19V S25A S49P S62T | 71 |
| 25818 (25841) | 1C11_H3.240_L3.92 | 3.15E-08 | 3.01E+05 | 9.49E-03 | I2V S9P A16E M36I A42P T63Y D66P T69Q G70E L76I V80Q S81D S88N F99Y | V2I L3V A19V S25A S49P S62T | 70 |
| 25819 (25842) | 1C11_H3.241_L3.92 | 3.31E-08 | 3.05E+05 | 1.01E-02 | Q1E I2V S9P A16E M36I A42P T63Y D66P T69Q G70E L76I V80Q S81D S88N F99Y | V2I L3V A19V S25A S49P S62T | 70 |

FIG. 17Q

| XENP | Variant Name | K$_D$ (M) | k$_a$ (1/Ms) | k$_d$ (1/s) | VH Variants | VL Variants | T$_m$ (°C) |
|---|---|---|---|---|---|---|---|
| 24854 (25820) | 1C11_H3_L3.144 | 3.01E-08 | 2.20E+05 | 6.61E-03 | | V2I L3V A19V S25A S49P L84V Q85E V89A V91T G108Q | 58.5 |
| 24858 (25821) | 1C11_H3_L3.148 | 2.65E-08 | 2.53E+05 | 6.69E-03 | | V2I L3V A19V S25A S49A L84V Q85E V89A V91T G108Q | 58 |
| 24847 (25822) | 1C11_H3.216_L3 | 3.79E-08 | 2.66E+05 | 1.01E-02 | I2V S9P A16E M36I A42P T63Y D66P L76I V80Q S88N F99Y | | 65.5 |
| 25305 (25823) | 1C11_H3.228_L3 | 3.70E-08 | 3.13E+05 | 1.16E-02 | Q1E I2V S9P A16E M36I T63Y D66P T69Q G70E V80Q S81D S88N F99Y | | 65 |
| 25311 (25824) | 1C11_H3.234_L3 | 3.29E-08 | 3.06E+05 | 1.01E-02 | Q1E I2V A16E M36I A42P T63Y D66P T69Q G70E V80Q S81D S88N F99Y | | 63.5 |
| 25318 (25831) | 1C11_H3.216_L3.144 | 3.87E-08 | 2.57E+05 | 9.93E-03 | I2V S9P A16E M36I A42P T63Y D66P L76I V80Q S88N F99Y | V2I L3V A19V S25A S49P L84V Q85E V89A V91T G108Q | 73 |
| 25319 (25832) | 1C11_H3.216_L3.148 | 4.36E-08 | 2.45E+05 | 1.07E-02 | I2V S9P A16E M36I A42P T63Y D66P L76I V80Q S88N F99Y | V2I L3V A19V S25A S49A L84V Q85E V89A V91T G108Q | 72.5 |

FIG. 18A

>XENP022553 1C11[PD-1]_H3L3_IgG1_PVA_/S267K Heavy Chain (SEQ ID NOS 41369-41373)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP022553 1C11[PD-1]_H3L3_IgG1_PVA_/S267K Light Chain (SEQ ID NOS 41374-41378)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP026321 1C11[PD-1]_H3.59_L3.1_IgG1_PVA_/S267K Heavy Chain (SEQ ID NOS 41379-41383)
QIQLVQSGSELKKPGASVKVSCKASGYTFTHYGMNWVRQAPGQGLEWMGWINTYTGEPTYADGFTGRFVFSLDTSQS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026321 1C11[PD-1]_H3.59_L3.1_IgG1_PVA_/S267K Light Chain (SEQ ID NOS 41384-41388)
DILMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP026322 1C11[PD-1]_H3.59_L3.38_IgG1_PVA_/S267K Heavy Chain (SEQ ID NOS 41389-41393)
QIQLVQSGSELKKPGASVKVSCKASGYTFTHYGMNWVRQAPGQGLEWMGWINTYTGEPTYADGFTGRFVFSLDTSQS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026322 1C11[PD-1]_H3.59_L3.38_IgG1_PVA_/S267K Light Chain (SEQ ID NOS 41394-41398)
DVLMTQSPDSLAVSLGERATINCKSSQSIVHSNGNNYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP026323 1C11[PD-1]_H3.59_L3.51_IgG1_PVA_/S267K Heavy Chain (SEQ ID NOS 41399-41403)
QIQLVQSGSELKKPGASVKVSCKASGYTFTHYGMNWVRQAPGQGLEWMGWINTYTGEPTYADGFTGRFVFSLDTSQS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026323 1C11[PD-1]_H3.59_L3.51_IgG1_PVA_/S267K Light Chain (SEQ ID NOS 41404-41408)
DVLMTQSPDSLAVSLGERATINCKSSQSIVHSNGNTYLEWYQQKPGQSPKLLIYSVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

FIG. 18B

>XENP026324 1C11[PD-1]_H3.59_L3.59_IgG1_PVA_/S267K Heavy Chain (SEQ ID NOS 41409-41413)
QIQLVQSGSELKKPGASVKVSCKASGYTFTHYGMNWVRQAPGQGLEWMGWINTYTGEPTYADGFTGRFVFSLDTSQS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026324 1C11[PD-1]_H3.59_L3.59_IgG1_PVA_/S267K Light Chain (SEQ ID NOS 41414-41418)
DVLMTQSPDSLAVSLGERATINCKSSQSIVHSNGNTYLEWYQQKPGQSPKLLIYKVSNRFSGVPDRFSGSGSGTDFT
LTISRLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP026325 1C11[PD-1]_H3.59_L3.73_IgG1_PVA_/S267K Heavy Chain (SEQ ID NOS 41419-41423)
QIQLVQSGSELKKPGASVKVSCKASGYTFTHYGMNWVRQAPGQGLEWMGWINTYTGEPTYADGFTGRFVFSLDTSQS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026325 1C11[PD-1]_H3.59_L3.73_IgG1_PVA_/S267K Light Chain (SEQ ID NOS 41424-41428)
DVLMTQSPDSLAVSLGERATINCKSSQSIVHSNGNTYLEWYQQKPGQSPKLLIYKVSNRFSGVPDRFSGSGSGTDFT
LTISSLQAEDVATYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP026326 1C11[PD-1]_H3.59_L3.125_IgG1_PVA_/S267K Heavy Chain (SEQ ID NOS 41429-41433)
QIQLVQSGSELKKPGASVKVSCKASGYTFTHYGMNWVRQAPGQGLEWMGWINTYTGEPTYADGFTGRFVFSLDTSQS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026326 1C11[PD-1]_H3.59_L3.125_IgG1_PVA_/S267K Light Chain (SEQ ID NOS 41434-41438)
DVLMTQSPDSLAVSLGERATINCKSSQSIVHSNGNTYLEWYQQKPGQSPKLLIYKVSNRFSGVPDRFSGSGSGTDFT
LTISSVEAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP026327 1C11[PD-1]_H3.135_L3.1_IgG1_PVA_/S267K Heavy Chain (SEQ ID NOS 41439-41443)
QIQLVQSGSELKKPGASVKVSCKASGYTFTHYGMNWVRQAPGQGLEWMGWINTYTSEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026327 1C11[PD-1]_H3.135_L3.1_IgG1_PVA_/S267K Light Chain (SEQ ID NOS 41444-41448)
DILMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

FIG. 18C

>XENP026328 1C11[PD-1]_H3.135_L3.38_IgG1_PVA_/S267K Heavy Chain (SEQ ID NOS 41449-41453)
QIQLVQSGSELKKPGASVKVSCKASGYTFTHYGMNWVRQAPGQGLEWMGWINTYTSEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026328 1C11[PD-1]_H3.135_L3.38_IgG1_PVA_/S267K Light Chain (SEQ ID NOS 41454-41458)
DVLMTQSPDSLAVSLGERATINCKSSQSIVHSNGNNYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP026329 1C11[PD-1]_H3.135_L3.51_IgG1_PVA_/S267K Heavy Chain (SEQ ID NOS 41459-41463)
QIQLVQSGSELKKPGASVKVSCKASGYTFTHYGMNWVRQAPGQGLEWMGWINTYTSEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026329 1C11[PD-1]_H3.135_L3.51_IgG1_PVA_/S267K Light Chain (SEQ ID NOS 41464-41468)
DVLMTQSPDSLAVSLGERATINCKSSQSIVHSNGNTYLEWYQQKPGQSPKLLIYSVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP026330 1C11[PD-1]_H3.135_L3.59_IgG1_PVA_/S267K Heavy Chain (SEQ ID NOS 41469-41473)
QIQLVQSGSELKKPGASVKVSCKASGYTFTHYGMNWVRQAPGQGLEWMGWINTYTSEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026330 1C11[PD-1]_H3.135_L3.59_IgG1_PVA_/S267K Light Chain (SEQ ID NOS 41474-41478)
DVLMTQSPDSLAVSLGERATINCKSSQSIVHSNGNTYLEWYQQKPGQSPKLLIYKVSNRFSGVPDRFSGSGSGTDFT
LTISRLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP026331 1C11[PD-1]_H3.135_L3.73_IgG1_PVA_/S267K Heavy Chain (SEQ ID NOS 41479-41483)
QIQLVQSGSELKKPGASVKVSCKASGYTFTHYGMNWVRQAPGQGLEWMGWINTYTSEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026331 1C11[PD-1]_H3.135_L3.73_IgG1_PVA_/S267K Light Chain (SEQ ID NOS 41484-41488)
DVLMTQSPDSLAVSLGERATINCKSSQSIVHSNGNTYLEWYQQKPGQSPKLLIYKVSNRFSGVPDRFSGSGSGTDFT
LTISSLQAEDVATYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

FIG. 18D

>XENP026332 1C11[PD-1]_H3.135_L3.125_IgG1_PVA_/S267K Heavy Chain (SEQ ID NOS 41489-41493)
QIQLVQSGSELKKPGASVKVSCKASGYTFTHYGMNWVRQAPGQGLEWMGWINTYTSEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026332 1C11[PD-1]_H3.135_L3.125_IgG1_PVA_/S267K Light Chain (SEQ ID NOS 41494-41498)
DVLMTQSPDSLAVSLGERATINCKSSQSIVHSNGNTYLEWYQQKPGQSPKLLIYKVSNRFSGVPDRFSGSGSGTDFT
LTISSVEAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP026333 1C11[PD-1]_H3.138_L3.1_IgG1_PVA_/S267K Heavy Chain (SEQ ID NOS 41499-41503)
QIQLVQSGSELKKPGASVKVSCKASGYTFTHYGMNWVRQAPGQGLEWMGWINTYTGDPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026333 1C11[PD-1]_H3.138_L3.1_IgG1_PVA_/S267K Light Chain (SEQ ID NOS 41504-41508)
DILMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP026334 1C11[PD-1]_H3.138_L3.38_IgG1_PVA_/S267K Heavy Chain (SEQ ID NOS 41509-41513)
QIQLVQSGSELKKPGASVKVSCKASGYTFTHYGMNWVRQAPGQGLEWMGWINTYTGDPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026334 1C11[PD-1]_H3.138_L3.38_IgG1_PVA_/S267K Light Chain (SEQ ID NOS 41514-41518)
DVLMTQSPDSLAVSLGERATINCKSSQSIVHSNGNNYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP026335 1C11[PD-1]_H3.138_L3.51_IgG1_PVA_/S267K Heavy Chain (SEQ ID NOS 41519-41523)
QIQLVQSGSELKKPGASVKVSCKASGYTFTHYGMNWVRQAPGQGLEWMGWINTYTGDPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026335 1C11[PD-1]_H3.138_L3.51_IgG1_PVA_/S267K Light Chain (SEQ ID NOS 41524-41528)
DVLMTQSPDSLAVSLGERATINCKSSQSIVHSNGNTYLEWYQQKPGQSPKLLIYSVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

FIG. 18E

>XENP026336 1C11[PD-1]_H3.138_L3.59_IgG1_PVA_/S267K Heavy Chain (SEQ ID NOS 41529-41533)
QIQLVQSGSELKKPGASVKVSCKASGYTFTHYGMNWVRQAPGQGLEWMGWINTYTGDPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026336 1C11[PD-1]_H3.138_L3.59_IgG1_PVA_/S267K Light Chain (SEQ ID NOS 41534-41538)
DVLMTQSPDSLAVSLGERATINCKSSQSIVHSNGNTYLEWYQQKPGQSPKLLIYKVSNRFSGVPDRFSGSGSGTDFT
LTISRLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP026337 1C11[PD-1]_H3.138_L3.73_IgG1_PVA_/S267K Heavy Chain (SEQ ID NOS 41539-41543)
QIQLVQSGSELKKPGASVKVSCKASGYTFTHYGMNWVRQAPGQGLEWMGWINTYTGDPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026337 1C11[PD-1]_H3.138_L3.73_IgG1_PVA_/S267K Light Chain (SEQ ID NOS 41544-41548)
DVLMTQSPDSLAVSLGERATINCKSSQSIVHSNGNTYLEWYQQKPGQSPKLLIYKVSNRFSGVPDRFSGSGSGTDFT
LTISSLQAEDVATYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP026338 1C11[PD-1]_H3.138_L3.125_IgG1_PVA_/S267K Heavy Chain (SEQ ID NOS 41549-41553)
QIQLVQSGSELKKPGASVKVSCKASGYTFTHYGMNWVRQAPGQGLEWMGWINTYTGDPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026338 1C11[PD-1]_H3.138_L3.125_IgG1_PVA_/S267K Light Chain (SEQ ID NOS 41554-41558)
DVLMTQSPDSLAVSLGERATINCKSSQSIVHSNGNTYLEWYQQKPGQSPKLLIYKVSNRFSGVPDRFSGSGSGTDFT
LTISSVEAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP026339 1C11[PD-1]_H3.155_L3.1_IgG1_PVA_/S267K Heavy Chain (SEQ ID NOS 41559-41563)
QIQLVQSGSELKKPGASVKVSCKASGYTFTHYGMNWVRQAPGQGLEWMGWINTYTGEPTYADGFTGRFVFSLDNSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026339 1C11[PD-1]_H3.155_L3.1_IgG1_PVA_/S267K Light Chain (SEQ ID NOS 41564-41568)
DILMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

FIG. 18F

>XENP026340 1C11[PD-1]_H3.155_L3.38_IgG1_PVA_/S267K Heavy Chain (SEQ ID NOS 41569-41573)
QIQLVQSGSELKKPGASVKVSCKASGYTFTHYGMNWVRQAPGQGLEWMGWINTYTGEPTYADGFTGRFVFSLDNSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026340 1C11[PD-1]_H3.155_L3.38_IgG1_PVA_/S267K Light Chain (SEQ ID NOS 41574-41578)
DVLMTQSPDSLAVSLGERATINCKSSQSIVHSNGNNYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP026341 1C11[PD-1]_H3.155_L3.51_IgG1_PVA_/S267K Heavy Chain (SEQ ID NOS 41579-41583)
QIQLVQSGSELKKPGASVKVSCKASGYTFTHYGMNWVRQAPGQGLEWMGWINTYTGEPTYADGFTGRFVFSLDNSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026341 1C11[PD-1]_H3.155_L3.51_IgG1_PVA_/S267K Light Chain (SEQ ID NOS 41584-41588)
DVLMTQSPDSLAVSLGERATINCKSSQSIVHSNGNTYLEWYQQKPGQSPKLLIYSVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP026342 1C11[PD-1]_H3.155_L3.59_IgG1_PVA_/S267K Heavy Chain (SEQ ID NOS 41589-41593)
QIQLVQSGSELKKPGASVKVSCKASGYTFTHYGMNWVRQAPGQGLEWMGWINTYTGEPTYADGFTGRFVFSLDNSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026342 1C11[PD-1]_H3.155_L3.59_IgG1_PVA_/S267K Light Chain (SEQ ID NOS 41594-41598)
DVLMTQSPDSLAVSLGERATINCKSSQSIVHSNGNTYLEWYQQKPGQSPKLLIYKVSNRFSGVPDRFSGSGSGTDFT
LTISRLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP026343 1C11[PD-1]_H3.155_L3.73_IgG1_PVA_/S267K Heavy Chain (SEQ ID NOS 41599-41603)
QIQLVQSGSELKKPGASVKVSCKASGYTFTHYGMNWVRQAPGQGLEWMGWINTYTGEPTYADGFTGRFVFSLDNSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026343 1C11[PD-1]_H3.155_L3.73_IgG1_PVA_/S267K Light Chain (SEQ ID NOS 41604-41608)
DVLMTQSPDSLAVSLGERATINCKSSQSIVHSNGNTYLEWYQQKPGQSPKLLIYKVSNRFSGVPDRFSGSGSGTDFT
LTISSLQAEDVATYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

FIG. 18G

>XENP026344 1C11[PD-1]_H3.155_L3.125_IgG1_PVA_/S267K Heavy Chain (SEQ ID NOS 41609-41613)
QIQLVQSGSELKKPGASVKVSCKASGYTFTHYGMNWVRQAPGQGLEWMGWINTYTGEPTYADGFTGRFVFSLDNSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026344 1C11[PD-1]_H3.155_L3.125_IgG1_PVA_/S267K Light Chain (SEQ ID NOS 41614-41618)
DVLMTQSPDSLAVSLGERATINCKSSQSIVHSNGNTYLEWYQQKPGQSPKLLIYKVSNRFSGVPDRFSGSGSGTDFT
LTISSVEAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

FIG. 19

| XENP | Variant | $K_D$ (M) | $k_a$ (1/Ms) | $k_d$ (1/s) |
|---|---|---|---|---|
| 26321 | 1C11[PD-1]_H3.59_L3.1 | 1.28E-08 | 1.90E+05 | 2.43E-03 |
| 26322 | 1C11[PD-1]_H3.59_L3.38 | 7.15E-09 | 2.13E+05 | 1.52E-03 |
| 26323 | 1C11[PD-1]_H3.59_L3.51 | 1.54E-08 | 2.23E+05 | 3.44E-03 |
| 26324 | 1C11[PD-1]_H3.59_L3.59 | 1.74E-08 | 1.98E+05 | 3.43E-03 |
| 26325 | 1C11[PD-1]_H3.59_L3.73 | 1.86E-08 | 1.92E+05 | 3.56E-03 |
| 26326 | 1C11[PD-1]_H3.59_L3.125 | 1.78E-08 | 2.05E+05 | 3.64E-03 |
| 26327 | 1C11[PD-1]_H3.135_L3.1 | 1.45E-08 | 2.04E+05 | 2.96E-03 |
| 26328 | 1C11[PD-1]_H3.135_L3.38 | 8.90E-09 | 2.19E+05 | 1.94E-03 |
| 26329 | 1C11[PD-1]_H3.135_L3.51 | 1.86E-08 | 2.10E+05 | 3.90E-03 |
| 26330 | 1C11[PD-1]_H3.135_L3.59 | 1.66E-08 | 2.30E+05 | 3.82E-03 |
| 26331 | 1C11[PD-1]_H3.135_L3.73 | 1.81E-08 | 2.10E+05 | 3.81E-03 |
| 26332 | 1C11[PD-1]_H3.135_L3.125 | 1.92E-08 | 2.05E+05 | 3.93E-03 |
| 26333 | 1C11[PD-1]_H3.138_L3.1 | 1.81E-08 | 1.92E+05 | 3.49E-03 |
| 26334 | 1C11[PD-1]_H3.138_L3.38 | 1.33E-08 | 1.99E+05 | 2.64E-03 |
| 26335 | 1C11[PD-1]_H3.138_L3.51 | 2.61E-08 | 2.01E+05 | 5.25E-03 |
| 26336 | 1C11[PD-1]_H3.138_L3.59 | 1.92E-08 | 2.31E+05 | 4.44E-03 |
| 26337 | 1C11[PD-1]_H3.138_L3.73 | 1.94E-08 | 3.26E+05 | 6.32E-03 |
| 26338 | 1C11[PD-1]_H3.138_L3.125 | 2.20E-08 | 3.19E+05 | 7.01E-03 |
| 26339 | 1C11[PD-1]_H3.155_L3.1 | 1.78E-08 | 3.05E+05 | 5.41E-03 |
| 26340 | 1C11[PD-1]_H3.155_L3.38 | 1.42E-08 | 3.20E+05 | 4.55E-03 |
| 26341 | 1C11[PD-1]_H3.155_L3.51 | 2.86E-08 | 2.80E+05 | 8.01E-03 |
| 26342 | 1C11[PD-1]_H3.155_L3.59 | 2.27E-08 | 3.10E+05 | 7.03E-03 |
| 26343 | 1C11[PD-1]_H3.155_L3.73 | 2.55E-08 | 2.91E+05 | 7.41E-03 |
| 26344 | 1C11[PD-1]_H3.155_L3.125 | 2.03E-08 | 3.66E+05 | 7.41E-03 |
| 22553 | 1C11[PD-1]_H3L3 | 1.94E-08 | 3.24E+05 | 6.29E-03 |

FIG. 20A

>XenD17478 1C11[PD-1]_H3_IgG1_PVA_/S267K (SEQ ID NOS 41619-41623)
QIQLVQSGSELKKPGASVKVSCKASGYTFT<u>HYGMN</u>WVRQAPGQGLEWMG<u>WINTYTGEPTYADGFTGRFVFSLDTSVS</u>
TAYLQISSLKAEDTAVYFCAR<u>DYYGSSPYW</u>GQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD18576 1C11_H3.59_IgG1_PVA_/S267K (SEQ ID NOS 41624-41628)
QIQLVQSGSELKKPGASVKVSCKASGYTFT<u>HYGMN</u>WVRQAPGQGLEWMG<u>WINTYTGEPTYADGFTGRFVFSLDTSQS</u>
TAYLQISSLKAEDTAVYFCAR<u>DYYGSSPYW</u>GQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22097 1C11_H3.242_IgG1_PVA_/S267K (SEQ ID NOS 41629-41633)
QIQLVQSGSELKKPGASVKVSCKASAYTFT<u>HYGMN</u>WVRQAPGQGLEWMG<u>WINTYTGEPTYADGFTGRFVFSLDTSVS</u>
TAYLQISSLKAEDTAVYFCAR<u>DYYGSSPYW</u>GQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22098 1C11_H3.243_IgG1_PVA_/S267K (SEQ ID NOS 41634-41638)
QIQLVQSGSELKKPGASVKVSCKASSYTFT<u>HYGMN</u>WVRQAPGQGLEWMG<u>WINTYTGEPTYADGFTGRFVFSLDTSVS</u>
TAYLQISSLKAEDTAVYFCAR<u>DYYGSSPYW</u>GQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22099 1C11_H3.244_IgG1_PVA_/S267K (SEQ ID NOS 41639-41643)
QIQLVQSGSELKKPGASVKVSCKASTYTFT<u>HYGMN</u>WVRQAPGQGLEWMG<u>WINTYTGEPTYADGFTGRFVFSLDTSVS</u>
TAYLQISSLKAEDTAVYFCAR<u>DYYGSSPYW</u>GQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22100 1C11_H3.245_IgG1_PVA_/S267K (SEQ ID NOS 41644-41648)
QIQLVQSGSELKKPGASVKVSCKASGWTFT<u>HYGMN</u>WVRQAPGQGLEWMG<u>WINTYTGEPTYADGFTGRFVFSLDTSVS</u>
TAYLQISSLKAEDTAVYFCAR<u>DYYGSSPYW</u>GQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

FIG. 20B

>XenD22101 1C11_H3.246_IgG1_PVA_/S267K (SEQ ID NOS 41649-41653)
QIQLVQSGSELKKPGASVKVSCKASGLTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22102 1C11_H3.247_IgG1_PVA_/S267K (SEQ ID NOS 41654-41658)
QIQLVQSGSELKKPGASVKVSCKASGHTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22103 1C11_H3.248_IgG1_PVA_/S267K (SEQ ID NOS 41659-41663)
QIQLVQSGSELKKPGASVKVSCKASGQTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22104 1C11_H3.249_IgG1_PVA_/S267K (SEQ ID NOS 41664-41668)
QIQLVQSGSELKKPGASVKVSCKASGDTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22105 1C11_H3.250_IgG1_PVA_/S267K (SEQ ID NOS 41669-41673)
QIQLVQSGSELKKPGASVKVSCKASGKTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22106 1C11_H3.251_IgG1_PVA_/S267K (SEQ ID NOS 41674-41678)
QIQLVQSGSELKKPGASVKVSCKASGYVFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

FIG. 20C

>XenD22107 1C11_H3.252_IgG1_PVA_/S267K (SEQ ID NOS 41679-41683)
QIQLVQSGSELKKPGASVKVSCKASGYAFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22108 1C11_H3.253_IgG1_PVA_/S267K (SEQ ID NOS 41684-41688)
QIQLVQSGSELKKPGASVKVSCKASGYIFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22109 1C11_H3.254_IgG1_PVA_/S267K (SEQ ID NOS 41689-41693)
QIQLVQSGSELKKPGASVKVSCKASGYQFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22110 1C11_H3.255_IgG1_PVA_/S267K (SEQ ID NOS 41694-41698)
QIQLVQSGSELKKPGASVKVSCKASGYTYTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22111 1C11_H3.256_IgG1_PVA_/S267K (SEQ ID NOS 41699-41703)
QIQLVQSGSELKKPGASVKVSCKASGYTWTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22112 1C11_H3.257_IgG1_PVA_/S267K (SEQ ID NOS 41704-41708)
QIQLVQSGSELKKPGASVKVSCKASGYTHTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

FIG. 20D

>XenD22113 1C11_H3.258_IgG1_PVA_/S267K (SEQ ID NOS 41709-41713)
QIQLVQSGSELKKPGASVKVSCKASGYTFVHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22114 1C11_H3.259_IgG1_PVA_/S267K (SEQ ID NOS 41714-41718)
QIQLVQSGSELKKPGASVKVSCKASGYTFAHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22115 1C11_H3.260_IgG1_PVA_/S267K (SEQ ID NOS 41719-41723)
QIQLVQSGSELKKPGASVKVSCKASGYTFIHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22116 1C11_H3.261_IgG1_PVA_/S267K (SEQ ID NOS 41724-41728)
QIQLVQSGSELKKPGASVKVSCKASGYTFQHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22117 1C11_H3.262_IgG1_PVA_/S267K (SEQ ID NOS 41729-41733)
QIQLVQSGSELKKPGASVKVSCKASGYTFTYYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22118 1C11_H3.263_IgG1_PVA_/S267K (SEQ ID NOS 41734-41738)
QIQLVQSGSELKKPGASVKVSCKASGYTFTQYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

FIG. 20E

>XenD22119 1C11_H3.264_IgG1_PVA_/S267K (SEQ ID NOS 41739-41743)
QIQLVQSGSELKKPGASVKVSCKASGYTFTDYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22120 1C11_H3.265_IgG1_PVA_/S267K (SEQ ID NOS 41744-41748)
QIQLVQSGSELKKPGASVKVSCKASGYTFTRYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22121 1C11_H3.266_IgG1_PVA_/S267K (SEQ ID NOS 41749-41753)
QIQLVQSGSELKKPGASVKVSCKASGYTFTFYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22122 1C11_H3.267_IgG1_PVA_/S267K (SEQ ID NOS 41754-41758)
QIQLVQSGSELKKPGASVKVSCKASGYTFTHFGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22123 1C11_H3.268_IgG1_PVA_/S267K (SEQ ID NOS 41759-41763)
QIQLVQSGSELKKPGASVKVSCKASGYTFTHHGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22124 1C11_H3.269_IgG1_PVA_/S267K (SEQ ID NOS 41764-41768)
QIQLVQSGSELKKPGASVKVSCKASGYTFTHLGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

FIG. 20F

>XenD22125 1C11_H3.270_IgG1_PVA_/S267K (SEQ ID NOS 41769-41773)
QIQLVQSGSELKKPGASVKVSCKASGYTFTHWGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22126 1C11_H3.271_IgG1_PVA_/S267K (SEQ ID NOS 41774-41778)
QIQLVQSGSELKKPGASVKVSCKASGYTFTHYTMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22127 1C11_H3.272_IgG1_PVA_/S267K (SEQ ID NOS 41779-41783)
QIQLVQSGSELKKPGASVKVSCKASGYTFTHYQMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22128 1C11_H3.273_IgG1_PVA_/S267K (SEQ ID NOS 41784-41788)
QIQLVQSGSELKKPGASVKVSCKASGYTFTHYGLNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22129 1C11_H3.274_IgG1_PVA_/S267K (SEQ ID NOS 41789-41793)
QIQLVQSGSELKKPGASVKVSCKASGYTFTHYGMNWLRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22130 1C11_H3.275_IgG1_PVA_/S267K (SEQ ID NOS 41794-41798)
QIQLVQSGSELKKPGASVKVSCKASGYTFTHYGMNWTRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

FIG. 20G

>XenD22131 1C11_H3.276_IgG1_PVA_/S267K (SEQ ID NOS 41799-41803)
QIQLVQSGSELKKPGASVKVSCKASGYTFTHYGMNWFRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22132 1C11_H3.277_IgG1_PVA_/S267K (SEQ ID NOS 41804-41808)
QIQLVQSGSELKKPGASVKVSCKASGYTFTHYGMNWVRQAPGQGLEWMTWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22133 1C11_H3.278_IgG1_PVA_/S267K (SEQ ID NOS 41809-41813)
QIQLVQSGSELKKPGASVKVSCKASGYTFTHYGMNWVRQAPGQGLEWMDWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22134 1C11_H3.279_IgG1_PVA_/S267K (SEQ ID NOS 41814-41818)
QIQLVQSGSELKKPGASVKVSCKASGYTFTHYGMNWVRQAPGQGLEWMQWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22135 1C11_H3.280_IgG1_PVA_/S267K (SEQ ID NOS 41819-41823)
QIQLVQSGSELKKPGASVKVSCKASGYTFTHYGMNWVRQAPGQGLEWMEWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22136 1C11_H3.281_IgG1_PVA_/S267K (SEQ ID NOS 41824-41828)
QIQLVQSGSELKKPGASVKVSCKASGYTFTHYGMNWVRQAPGQGLEWMGFINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

FIG. 20H

>XenD22137 1C11_H3.282_IgG1_PVA_/S267K (SEQ ID NOS 41829-41833)
QIQLVQSGSELKKPGASVKVSCKASGYTFTHYGMNWVRQAPGQGLEWMGHINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22138 1C11_H3.283_IgG1_PVA_/S267K (SEQ ID NOS 41834-41838)
QIQLVQSGSELKKPGASVKVSCKASGYTFTHYGMNWVRQAPGQGLEWMGWIQTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22139 1C11_H3.284_IgG1_PVA_/S267K (SEQ ID NOS 41839-41843)
QIQLVQSGSELKKPGASVKVSCKASGYTFTHYGMNWVRQAPGQGLEWMGWIETYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22140 1C11_H3.285_IgG1_PVA_/S267K (SEQ ID NOS 41844-41848)
QIQLVQSGSELKKPGASVKVSCKASGYTFTHYGMNWVRQAPGQGLEWMGWIHTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22141 1C11_H3.286_IgG1_PVA_/S267K (SEQ ID NOS 41849-41853)
QIQLVQSGSELKKPGASVKVSCKASGYTFTHYGMNWVRQAPGQGLEWMGWISTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22142 1C11_H3.287_IgG1_PVA_/S267K (SEQ ID NOS 41854-41858)
QIQLVQSGSELKKPGASVKVSCKASGYTFTHYGMNWVRQAPGQGLEWMGWINTFTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

FIG. 201

>XenD22143 1C11_H3.288_IgG1_PVA_/S267K (SEQ ID NOS 41859-41863)
QIQLVQSGSELKKPGASVKVSCKASGYTFTHYGMNWVRQAPGQGLEWMGWINTHTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22144 1C11_H3.289_IgG1_PVA_/S267K (SEQ ID NOS 41864-41868)
QIQLVQSGSELKKPGASVKVSCKASGYTFTHYGMNWVRQAPGQGLEWMGWINTLTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22145 1C11_H3.290_IgG1_PVA_/S267K (SEQ ID NOS 41869-41873)
QIQLVQSGSELKKPGASVKVSCKASGYTFTHYGMNWVRQAPGQGLEWMGWINTWTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22146 1C11_H3.291_IgG1_PVA_/S267K (SEQ ID NOS 41874-41878)
QIQLVQSGSELKKPGASVKVSCKASGYTFTHYGMNWVRQAPGQGLEWMGWINTYVGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22147 1C11_H3.292_IgG1_PVA_/S267K (SEQ ID NOS 41879-41883)
QIQLVQSGSELKKPGASVKVSCKASGYTFTHYGMNWVRQAPGQGLEWMGWINTYSGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22148 1C11_H3.293_IgG1_PVA_/S267K (SEQ ID NOS 41884-41888)
QIQLVQSGSELKKPGASVKVSCKASGYTFTHYGMNWVRQAPGQGLEWMGWINTYAGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

FIG. 20J

>XenD22149 1C11_H3.294_IgG1_PVA_/S267K (SEQ ID NOS 41889-41893)
QIQLVQSGSELKKPGASVKVSCKASGYTFTHYGMNWVRQAPGQGLEWMGWINTYIGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22150 1C11_H3.295_IgG1_PVA_/S267K (SEQ ID NOS 41894-41898)
QIQLVQSGSELKKPGASVKVSCKASGYTFTHYGMNWVRQAPGQGLEWMGWINTYTGQPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22151 1C11_H3.296_IgG1_PVA_/S267K (SEQ ID NOS 41899-41903)
QIQLVQSGSELKKPGASVKVSCKASGYTFTHYGMNWVRQAPGQGLEWMGWINTYTGKPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22152 1C11_H3.297_IgG1_PVA_/S267K (SEQ ID NOS 41904-41908)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDFYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22153 1C11_H3.298_IgG1_PVA_/S267K (SEQ ID NOS 41909-41913)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDQYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22154 1C11_H3.299_IgG1_PVA_/S267K (SEQ ID NOS 41914-41918)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDHYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

FIG. 20K

>XenD22155 1C11_H3.300_IgG1_PVA_/S267K (SEQ ID NOS 41919-41923)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDRYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22156 1C11_H3.301_IgG1_PVA_/S267K (SEQ ID NOS 41924-41928)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDKYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22157 1C11_H3.302_IgG1_PVA_/S267K (SEQ ID NOS 41929-41933)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYWGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22158 1C11_H3.303_IgG1_PVA_/S267K (SEQ ID NOS 41934-41938)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYFGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22159 1C11_H3.304_IgG1_PVA_/S267K (SEQ ID NOS 41939-41943)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYASSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22160 1C11_H3.305_IgG1_PVA_/S267K (SEQ ID NOS 41944-41948)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYSSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

FIG. 20L

>XenD22161 1C11_H3.306_IgG1_PVA_/S267K (SEQ ID NOS 41949-41953)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPFWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XenD22162 1C11_H3.307_IgG1_PVA_/S267K (SEQ ID NOS 41954-41958)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPWWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

FIG. 21A

>XenD17482 1C11[PD-1]_L3 (SEQ ID NOS 41959-41963)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD18472 1C11_L3.38 (SEQ ID NOS 41964-41968)
DVLMTQSPDSLAVSLGERATINCKSSQSIVHSNGNNYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22163 1C11[PD-1]_L3.149 (SEQ ID NOS 41969-41973)
DVLMTQSPDSLAVSLGERATINCKSSQSIVYSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22164 1C11[PD-1]_L3.150 (SEQ ID NOS 41974-41978)
DVLMTQSPDSLAVSLGERATINCKSSQSIVQSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22165 1C11[PD-1]_L3.151 (SEQ ID NOS 41979-41983)
DVLMTQSPDSLAVSLGERATINCKSSQSIVDSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22166 1C11[PD-1]_L3.152 (SEQ ID NOS 41984-41988)
DVLMTQSPDSLAVSLGERATINCKSSQSIVFSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22167 1C11[PD-1]_L3.153 (SEQ ID NOS 41989-41993)
DVLMTQSPDSLAVSLGERATINCKSSQSIVTSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22168 1C11[PD-1]_L3.154 (SEQ ID NOS 41994-41998)
DVLMTQSPDSLAVSLGERATINCKSSQSIVKSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22169 1C11[PD-1]_L3.155 (SEQ ID NOS 41999-42003)
DVLMTQSPDSLAVSLGERATINCKSSQSIVHTNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22170 1C11[PD-1]_L3.156 (SEQ ID NOS 42004-42008)
DVLMTQSPDSLAVSLGERATINCKSSQSIVHANGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

FIG. 21B

>XenD22171 1C11[PD-1]_L3.157 (SEQ ID NOS 42009-42013)
DVLMTQSPDSLAVSLGERATINCKSSQSIVHQNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22172 1C11[PD-1]_L3.158 (SEQ ID NOS 42014-42018)
DVLMTQSPDSLAVSLGERATINCKSSQSIVHGNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22173 1C11[PD-1]_L3.159 (SEQ ID NOS 42019-42023)
DVLMTQSPDSLAVSLGERATINCKSSQSIVHVNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22174 1C11[PD-1]_L3.160 (SEQ ID NOS 42024-42028)
DVLMTQSPDSLAVSLGERATINCKSSQSIVHSHGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22175 1C11[PD-1]_L3.161 (SEQ ID NOS 42029-42033)
DVLMTQSPDSLAVSLGERATINCKSSQSIVHSEGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22176 1C11[PD-1]_L3.162 (SEQ ID NOS 42034-42038)
DVLMTQSPDSLAVSLGERATINCKSSQSIVHSSGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22177 1C11[PD-1]_L3.163 (SEQ ID NOS 42039-42043)
DVLMTQSPDSLAVSLGERATINCKSSQSIVHSRGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22178 1C11[PD-1]_L3.164 (SEQ ID NOS 42044-42048)
DVLMTQSPDSLAVSLGERATINCKSSQSIVHSLGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22179 1C11[PD-1]_L3.165 (SEQ ID NOS 42049-42053)
DVLMTQSPDSLAVSLGERATINCKSSQSIVHSNANTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22180 1C11[PD-1]_L3.166 (SEQ ID NOS 42054-42058)
DVLMTQSPDSLAVSLGERATINCKSSQSIVHSNSNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

FIG. 21C

>XenD22181 1C11[PD-1]_L3.167 (SEQ ID NOS 42059-42063)
DVLMTQSPDSLAVSLGERATINCKSSQSIVHSNTNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22182 1C11[PD-1]_L3.168 (SEQ ID NOS 42064-42068)
DVLMTQSPDSLAVSLGERATINCKSSQSIVHSNQNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22183 1C11[PD-1]_L3.169 (SEQ ID NOS 42069-42073)
DVLMTQSPDSLAVSLGERATINCKSSQSIVHSNGDTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22184 1C11[PD-1]_L3.170 (SEQ ID NOS 42074-42078)
DVLMTQSPDSLAVSLGERATINCKSSQSIVHSNGHTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22185 1C11[PD-1]_L3.171 (SEQ ID NOS 42079-42083)
DVLMTQSPDSLAVSLGERATINCKSSQSIVHSNGETYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22186 1C11[PD-1]_L3.172 (SEQ ID NOS 42084-42088)
DVLMTQSPDSLAVSLGERATINCKSSQSIVHSNGRTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22187 1C11[PD-1]_L3.173 (SEQ ID NOS 42089-42093)
DVLMTQSPDSLAVSLGERATINCKSSQSIVHSNGNTFLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22188 1C11[PD-1]_L3.174 (SEQ ID NOS 42094-42098)
DVLMTQSPDSLAVSLGERATINCKSSQSIVHSNGNTHLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22189 1C11[PD-1]_L3.175 (SEQ ID NOS 42099-42103)
DVLMTQSPDSLAVSLGERATINCKSSQSIVHSNGNTLLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22190 1C11[PD-1]_L3.176 (SEQ ID NOS 42104-42108)
DVLMTQSPDSLAVSLGERATINCKSSQSIVHSNGNTWLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

FIG. 21D

>XenD22191 1C11[PD-1]_L3.177 (SEQ ID NOS 42109-42113)
DVLMTQSPDSLAVSLGERATINCKSSQSIVHSNGNTQLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22192 1C11[PD-1]_L3.178 (SEQ ID NOS 42114-42118)
DVLMTQSPDSLAVSLGERATINCKSSQSIVHSNGNTYLEWYQQKPGQSPKLLIFKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22193 1C11[PD-1]_L3.179 (SEQ ID NOS 42119-42123)
DVLMTQSPDSLAVSLGERATINCKSSQSIVHSNGNTYLEWYQQKPGQSPKLLIHKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22194 1C11[PD-1]_L3.180 (SEQ ID NOS 42124-42128)
DVLMTQSPDSLAVSLGERATINCKSSQSIVHSNGNTYLEWYQQKPGQSPKLLILKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22195 1C11[PD-1]_L3.181 (SEQ ID NOS 42129-42133)
DVLMTQSPDSLAVSLGERATINCKSSQSIVHSNGNTYLEWYQQKPGQSPKLLIWKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22196 1C11[PD-1]_L3.182 (SEQ ID NOS 42134-42138)
DVLMTQSPDSLAVSLGERATINCKSSQSIVHSNGNTYLEWYQQKPGQSPKLLIQKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22197 1C11[PD-1]_L3.183 (SEQ ID NOS 42139-42143)
DVLMTQSPDSLAVSLGERATINCKSSQSIVHSNGNTYLEWYQQKPGQSPKLLIYKISNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22198 1C11[PD-1]_L3.184 (SEQ ID NOS 42144-42148)
DVLMTQSPDSLAVSLGERATINCKSSQSIVHSNGNTYLEWYQQKPGQSPKLLIYKLSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22199 1C11[PD-1]_L3.185 (SEQ ID NOS 42149-42153)
DVLMTQSPDSLAVSLGERATINCKSSQSIVHSNGNTYLEWYQQKPGQSPKLLIYKSSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22200 1C11[PD-1]_L3.186 (SEQ ID NOS 42154-42158)
DVLMTQSPDSLAVSLGERATINCKSSQSIVHSNGNTYLEWYQQKPGQSPKLLIYKVSDRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

FIG. 21E

>XenD22201 1C11[PD-1]_L3.187 (SEQ ID NOS 42159-42163)
DVLMTQSPDSLAVSLGERATINCKSSQSIVHSNGNTYLEWYQQKPGQSPKLLIYKVSHRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22202 1C11[PD-1]_L3.188 (SEQ ID NOS 42164-42168)
DVLMTQSPDSLAVSLGERATINCKSSQSIVHSNGNTYLEWYQQKPGQSPKLLIYKVSERFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22203 1C11[PD-1]_L3.189 (SEQ ID NOS 42169-42173)
DVLMTQSPDSLAVSLGERATINCKSSQSIVHSNGNTYLEWYQQKPGQSPKLLIYKVSRRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22204 1C11[PD-1]_L3.190 (SEQ ID NOS 42174-42178)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCMQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22205 1C11[PD-1]_L3.191 (SEQ ID NOS 42179-42183)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCEQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22206 1C11[PD-1]_L3.192 (SEQ ID NOS 42184-42188)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQASHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22207 1C11[PD-1]_L3.193 (SEQ ID NOS 42189-42193)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQSSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22208 1C11[PD-1]_L3.194 (SEQ ID NOS 42194-42198)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQDSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22209 1C11[PD-1]_L3.195 (SEQ ID NOS 42199-42203)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQTSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22210 1C11[PD-1]_L3.196 (SEQ ID NOS 42204-42208)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQQSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

FIG. 21F

>XenD22211 1C11[PD-1]_L3.197 (SEQ ID NOS 42209-42213)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQHSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22212 1C11[PD-1]_L3.198 (SEQ ID NOS 42214-42218)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQLSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22213 1C11[PD-1]_L3.199 (SEQ ID NOS 42219-42223)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQRSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22214 1C11[PD-1]_L3.200 (SEQ ID NOS 42224-42228)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQFSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22215 1C11[PD-1]_L3.201 (SEQ ID NOS 42229-42233)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGTHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22216 1C11[PD-1]_L3.202 (SEQ ID NOS 42234-42238)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGAHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22217 1C11[PD-1]_L3.203 (SEQ ID NOS 42239-42243)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGQHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22218 1C11[PD-1]_L3.204 (SEQ ID NOS 42244-42248)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGVHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22219 1C11[PD-1]_L3.205 (SEQ ID NOS 42249-42253)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSYVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22220 1C11[PD-1]_L3.206 (SEQ ID NOS 42254-42258)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSQVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

FIG. 21G

>XenD22221 1C11[PD-1]_L3.207 (SEQ ID NOS 42259-42263)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSDVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22222 1C11[PD-1]_L3.208 (SEQ ID NOS 42264-42268)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSFVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XenD22223 1C11[PD-1]_L3.209 (SEQ ID NOS 42269-42273)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSTVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

FIG. 22A

| Variant Name | HC XenD | LC XenD | VH Variants | VL Variants | $K_D$ (M) | $k_a$ (1/Ms) | $k_d$ (1/s) |
|---|---|---|---|---|---|---|---|
| 1C11_H3L3 | XenD17478 | XenD17482 | - | - | 5.35E-08 | 2.27E+05 | 1.22E-02 |
| 1C11_H3.59_L3.38 | XenD18576 | XenD18472 | V80Q | T37N | 1.57E-08 | 3.08E+05 | 4.83E-03 |
| 1C11_H3.242_L3 | XenD22097 | XenD17482 | G26A | - | 3.65E-08 | 2.92E+05 | 1.07E-02 |
| 1C11_H3.243_L3 | XenD22098 | XenD17482 | G26S | - | 3.08E-08 | 3.96E+05 | 1.22E-02 |
| 1C11_H3.244_L3 | XenD22099 | XenD17482 | G26T | - | 1.46E-08 | 3.82E+05 | 5.56E-03 |
| 1C11_H3.245_L3 | XenD22100 | XenD17482 | Y27W | - | 2.94E-08 | 5.02E+05 | 1.48E-02 |
| 1C11_H3.246_L3 | XenD22101 | XenD17482 | Y27L | - | 8.55E-08 | 5.15E+05 | 4.41E-02 |
| 1C11_H3.247_L3 | XenD22102 | XenD17482 | Y27H | - | 1.38E-07 | 2.73E+05 | 3.76E-02 |
| 1C11_H3.248_L3 | XenD22103 | XenD17482 | Y27Q | - | 1.06E-07 | 3.44E+05 | 3.66E-02 |
| 1C11_H3.249_L3 | XenD22104 | XenD17482 | Y27D | - | 4.70E-08 | 4.63E+05 | 2.18E-02 |
| 1C11_H3.250_L3 | XenD22105 | XenD17482 | Y27K | - | 1.50E-08 | 6.61E+05 | 9.88E-03 |
| 1C11_H3.251_L3 | XenD22106 | XenD17482 | T28V | - | 3.37E-08 | 2.48E+05 | 8.35E-03 |
| 1C11_H3.252_L3 | XenD22107 | XenD17482 | T28A | - | 7.63E-08 | 2.57E+05 | 1.96E-02 |
| 1C11_H3.253_L3 | XenD22108 | XenD17482 | T28I | - | 7.03E-08 | 2.86E+05 | 2.01E-02 |
| 1C11_H3.254_L3 | XenD22109 | XenD17482 | T28Q | - | 8.07E-08 | 2.15E+05 | 1.73E-02 |
| 1C11_H3.255_L3 | XenD22110 | XenD17482 | F29Y | - | 2.81E-08 | 3.45E+05 | 9.70E-03 |
| 1C11_H3.256_L3 | XenD22111 | XenD17482 | F29W | - | 1.86E-08 | 4.70E+05 | 8.73E-03 |
| 1C11_H3.257_L3 | XenD22112 | XenD17482 | F29H | - | 7.52E-08 | 6.83E+05 | 5.14E-02 |
| 1C11_H3.258_L3 | XenD22113 | XenD17482 | T30V | - | 1.56E-08 | 2.99E+05 | 4.68E-03 |
| 1C11_H3.259_L3 | XenD22114 | XenD17482 | T30A | - | 3.48E-08 | 3.72E+05 | 1.29E-02 |
| 1C11_H3.260_L3 | XenD22115 | XenD17482 | T30I | - | 4.18E-08 | 2.64E+05 | 1.11E-02 |
| 1C11_H3.261_L3 | XenD22116 | XenD17482 | T30Q | - | 3.05E-08 | 1.98E+05 | 6.04E-03 |
| 1C11_H3.262_L3 | XenD22117 | XenD17482 | H31Y | - | 5.45E-08 | 3.56E+05 | 1.94E-02 |
| 1C11_H3.263_L3 | XenD22118 | XenD17482 | H31Q | - | 1.15E-07 | 4.80E+05 | 5.49E-02 |
| 1C11_H3.264_L3 | XenD22119 | XenD17482 | H31D | - | 8.37E-08 | 4.58E+05 | 3.83E-02 |
| 1C11_H3.265_L3 | XenD22120 | XenD17482 | H31R | - | 1.60E-07 | 4.80E+05 | 7.66E-02 |
| 1C11_H3.266_L3 | XenD22121 | XenD17482 | H31F | - | 7.75E-08 | 5.45E+05 | 4.22E-02 |
| 1C11_H3.267_L3 | XenD22122 | XenD17482 | Y34F | - | 4.88E-08 | 4.38E+05 | 2.14E-02 |
| 1C11_H3.268_L3 | XenD22123 | XenD17482 | Y34H | - | 6.76E-08 | 2.63E+05 | 1.78E-02 |

FIG. 22B

| Variant Name | HC XenD | LC XenD | VH Variants | VL Variants | K$_D$ (M) | k$_a$ (1/Ms) | k$_d$ (1/s) |
|---|---|---|---|---|---|---|---|
| 1C11_H3.269_L3 | XenD22124 | XenD17482 | Y34L | - | 1.03E-07 | 4.99E+05 | 5.14E-02 |
| 1C11_H3.270_L3 | XenD22125 | XenD17482 | Y34W | - | 6.17E-08 | 4.47E+05 | 2.76E-02 |
| 1C11_H3.271_L3 | XenD22126 | XenD17482 | G35T | - | | | |
| 1C11_H3.272_L3 | XenD22127 | XenD17482 | G35Q | - | | | |
| 1C11_H3.273_L3 | XenD22128 | XenD17482 | M36L | - | 4.82E-08 | 4.15E+05 | 2.00E-02 |
| 1C11_H3.274_L3 | XenD22129 | XenD17482 | V39L | - | 4.14E-08 | 3.21E+05 | 1.33E-02 |
| 1C11_H3.275_L3 | XenD22130 | XenD17482 | V39T | - | | | |
| 1C11_H3.276_L3 | XenD22131 | XenD17482 | V39F | - | 1.42E-07 | 4.07E+05 | 5.76E-02 |
| 1C11_H3.277_L3 | XenD22132 | XenD17482 | G51T | - | | | |
| 1C11_H3.278_L3 | XenD22133 | XenD17482 | G51D | - | | | |
| 1C11_H3.279_L3 | XenD22134 | XenD17482 | G51Q | - | | | |
| 1C11_H3.280_L3 | XenD22135 | XenD17482 | G51E | - | | | |
| 1C11_H3.281_L3 | XenD22136 | XenD17482 | W52F | - | 2.64E-07 | 9.36E+05 | 2.47E-01 |
| 1C11_H3.282_L3 | XenD22137 | XenD17482 | W52H | - | | | |
| 1C11_H3.283_L3 | XenD22138 | XenD17482 | N54Q | - | 2.10E-07 | 6.90E+05 | 1.45E-01 |
| 1C11_H3.284_L3 | XenD22139 | XenD17482 | N54E | - | 1.06E-07 | 1.66E+06 | 1.75E-01 |
| 1C11_H3.285_L3 | XenD22140 | XenD17482 | N54H | - | 2.10E-07 | 1.17E+06 | 2.45E-01 |
| 1C11_H3.286_L3 | XenD22141 | XenD17482 | N54S | - | 1.66E-07 | 7.93E+05 | 1.32E-01 |
| 1C11_H3.287_L3 | XenD22142 | XenD17482 | Y56F | - | 5.24E-08 | 4.32E+05 | 2.26E-02 |
| 1C11_H3.288_L3 | XenD22143 | XenD17482 | Y56H | - | 2.05E-08 | 3.45E+05 | 7.08E-03 |
| 1C11_H3.289_L3 | XenD22144 | XenD17482 | Y56L | - | 9.79E-08 | 3.36E+05 | 3.29E-02 |
| 1C11_H3.290_L3 | XenD22145 | XenD17482 | Y56W | - | 8.91E-08 | 3.37E+05 | 3.00E-02 |
| 1C11_H3.291_L3 | XenD22146 | XenD17482 | T59V | - | 5.44E-08 | 4.71E+05 | 2.56E-02 |
| 1C11_H3.292_L3 | XenD22147 | XenD17482 | T59S | - | 3.16E-08 | 3.08E+05 | 9.72E-03 |
| 1C11_H3.293_L3 | XenD22148 | XenD17482 | T59A | - | 4.33E-08 | 3.67E+05 | 1.59E-02 |
| 1C11_H3.294_L3 | XenD22149 | XenD17482 | T59I | - | 1.53E-07 | 3.40E+05 | 5.22E-02 |
| 1C11_H3.295_L3 | XenD22150 | XenD17482 | E61Q | - | 6.46E-08 | 3.06E+05 | 1.98E-02 |
| 1C11_H3.296_L3 | XenD22151 | XenD17482 | E61K | - | 1.20E-07 | 2.01E+05 | 2.42E-02 |
| 1C11_H3.297_L3 | XenD22152 | XenD17482 | Y110F | - | 3.99E-08 | 3.68E+05 | 1.47E-02 |

FIG. 22C

| Variant Name | HC XenD | LC XenD | VH Variants | VL Variants | $K_D$ (M) | $k_a$ (1/Ms) | $k_d$ (1/s) |
|---|---|---|---|---|---|---|---|
| 1C11_H3.298_L3 | XenD22153 | XenD17482 | Y110Q | - | 4.00E-08 | 3.93E+05 | 1.57E-02 |
| 1C11_H3.299_L3 | XenD22154 | XenD17482 | Y110H | - | 4.16E-08 | 4.67E+05 | 1.94E-02 |
| 1C11_H3.300_L3 | XenD22155 | XenD17482 | Y110R | - | 2.99E-08 | 3.00E+05 | 8.98E-03 |
| 1C11_H3.301_L3 | XenD22156 | XenD17482 | Y110K | - | 7.04E-08 | 4.22E+05 | 2.97E-02 |
| 1C11_H3.302_L3 | XenD22157 | XenD17482 | Y111W | - | 4.23E-07 | 2.37E+05 | 1.00E-01 |
| 1C11_H3.303_L3 | XenD22158 | XenD17482 | Y111F | - | 1.37E-08 | 2.67E+05 | 3.66E-03 |
| 1C11_H3.304_L3 | XenD22159 | XenD17482 | G112A | - | 2.98E-07 | 3.29E+05 | 9.81E-02 |
| 1C11_H3.305_L3 | XenD22160 | XenD17482 | G112S | - | 7.23E-07 | 1.29E+05 | 9.35E-02 |
| 1C11_H3.306_L3 | XenD22161 | XenD17482 | Y116F | - | 3.62E-08 | 3.34E+05 | 1.21E-02 |
| 1C11_H3.307_L3 | XenD22162 | XenD17482 | Y116W | - | 6.87E-08 | 2.99E+05 | 2.05E-02 |
| 1C11_H3_L3.149 | XenD17478 | XenD22163 | - | H31Y | 5.36E-09 | 3.71E+05 | 1.99E-03 |
| 1C11_H3_L3.150 | XenD17478 | XenD22164 | - | H31Q | 1.64E-06 | 1.89E+05 | 3.11E-01 |
| 1C11_H3_L3.151 | XenD17478 | XenD22165 | - | H31D | 1.94E-06 | 1.39E+05 | 2.69E-01 |
| 1C11_H3_L3.152 | XenD17478 | XenD22166 | - | H31F | 2.88E-09 | 4.05E+05 | 1.17E-03 |
| 1C11_H3_L3.153 | XenD17478 | XenD22167 | - | H31T | 2.71E-07 | 1.22E+06 | 3.30E-01 |
| 1C11_H3_L3.154 | XenD17478 | XenD22168 | - | H31K | 8.36E-08 | 3.83E+06 | 3.20E-01 |
| 1C11_H3_L3.155 | XenD17478 | XenD22169 | - | S32T | 7.09E-08 | 2.95E+05 | 2.09E-02 |
| 1C11_H3_L3.156 | XenD17478 | XenD22170 | - | S32A | 4.05E-08 | 3.78E+05 | 1.53E-02 |
| 1C11_H3_L3.157 | XenD17478 | XenD22171 | - | S32Q | 7.70E-08 | 2.89E+05 | 2.22E-02 |
| 1C11_H3_L3.158 | XenD17478 | XenD22172 | - | S32G | 4.47E-08 | 2.52E+05 | 1.13E-02 |
| 1C11_H3_L3.159 | XenD17478 | XenD22173 | - | S32V | 4.54E-08 | 3.28E+05 | 1.49E-02 |
| 1C11_H3_L3.160 | XenD17478 | XenD22174 | - | N33H | 2.46E-08 | 7.40E+05 | 1.82E-02 |
| 1C11_H3_L3.161 | XenD17478 | XenD22175 | - | N33E | 2.51E-08 | 8.32E+05 | 2.09E-02 |
| 1C11_H3_L3.162 | XenD17478 | XenD22176 | - | N33S | 5.26E-08 | 4.53E+05 | 2.38E-02 |
| 1C11_H3_L3.163 | XenD17478 | XenD22177 | - | N33R | 9.95E-08 | 5.83E+05 | 5.80E-02 |
| 1C11_H3_L3.164 | XenD17478 | XenD22178 | - | N33L | 3.48E-08 | 7.39E+05 | 2.57E-02 |
| 1C11_H3_L3.165 | XenD17478 | XenD22179 | - | G34A | 3.22E-08 | 3.04E+05 | 9.76E-03 |
| 1C11_H3_L3.166 | XenD17478 | XenD22180 | - | G34S | 1.88E-08 | 4.56E+05 | 8.57E-03 |
| 1C11_H3_L3.167 | XenD17478 | XenD22181 | - | G34T | 2.52E-08 | 4.26E+05 | 1.07E-02 |

FIG. 22D

| Variant Name | HC XenD | LC XenD | VH Variants | VL Variants | $K_D$ (M) | $k_a$ (1/Ms) | $k_d$ (1/s) |
|---|---|---|---|---|---|---|---|
| 1C11_H3_L3.168 | XenD17478 | XenD22182 | - | G34Q | 1.22E-08 | 4.73E+05 | 5.75E-03 |
| 1C11_H3_L3.169 | XenD17478 | XenD22183 | - | N35D | 4.98E-08 | 3.34E+05 | 1.66E-02 |
| 1C11_H3_L3.170 | XenD17478 | XenD22184 | - | N35H | 3.64E-08 | 3.67E+05 | 1.34E-02 |
| 1C11_H3_L3.171 | XenD17478 | XenD22185 | - | N35E | 5.63E-08 | 3.60E+05 | 2.03E-02 |
| 1C11_H3_L3.172 | XenD17478 | XenD22186 | - | N35R | 3.66E-08 | 2.60E+05 | 9.49E-03 |
| 1C11_H3_L3.173 | XenD17478 | XenD22187 | - | Y38F | 2.69E-07 | 4.99E+05 | 1.34E-01 |
| 1C11_H3_L3.174 | XenD17478 | XenD22188 | - | Y38H | 1.22E-07 | 3.68E+06 | 4.49E-01 |
| 1C11_H3_L3.175 | XenD17478 | XenD22189 | - | Y38L | | | |
| 1C11_H3_L3.176 | XenD17478 | XenD22190 | - | Y38W | 1.90E-06 | 2.95E+05 | 5.61E-01 |
| 1C11_H3_L3.177 | XenD17478 | XenD22191 | - | Y38Q | | | |
| 1C11_H3_L3.178 | XenD17478 | XenD22192 | - | Y55F | 5.59E-08 | 3.80E+05 | 2.13E-02 |
| 1C11_H3_L3.179 | XenD17478 | XenD22193 | - | Y55H | 7.74E-08 | 3.17E+05 | 2.46E-02 |
| 1C11_H3_L3.180 | XenD17478 | XenD22194 | - | Y55L | 5.86E-09 | 8.21E+05 | 4.81E-03 |
| 1C11_H3_L3.181 | XenD17478 | XenD22195 | - | Y55W | 1.12E-07 | 5.20E+05 | 5.83E-02 |
| 1C11_H3_L3.182 | XenD17478 | XenD22196 | - | Y55Q | 1.07E-07 | 3.95E+05 | 4.23E-02 |
| 1C11_H3_L3.183 | XenD17478 | XenD22197 | - | V57I | 4.03E-08 | 3.76E+05 | 1.51E-02 |
| 1C11_H3_L3.184 | XenD17478 | XenD22198 | - | V57L | 4.31E-08 | 4.10E+05 | 1.77E-02 |
| 1C11_H3_L3.185 | XenD17478 | XenD22199 | - | V57S | 4.78E-08 | 3.69E+05 | 1.76E-02 |
| 1C11_H3_L3.186 | XenD17478 | XenD22200 | - | N59D | 3.45E-08 | 4.04E+05 | 1.40E-02 |
| 1C11_H3_L3.187 | XenD17478 | XenD22201 | - | N59H | 6.37E-08 | 3.30E+05 | 2.10E-02 |
| 1C11_H3_L3.188 | XenD17478 | XenD22202 | - | N59E | 6.21E-08 | 4.35E+05 | 2.70E-02 |
| 1C11_H3_L3.189 | XenD17478 | XenD22203 | - | N59R | 1.27E-07 | 3.52E+05 | 4.46E-02 |
| 1C11_H3_L3.190 | XenD17478 | XenD22204 | - | F95M | 6.64E-08 | 3.37E+05 | 2.24E-02 |
| 1C11_H3_L3.191 | XenD17478 | XenD22205 | - | F95E | 4.91E-08 | 5.92E+05 | 2.91E-02 |
| 1C11_H3_L3.192 | XenD17478 | XenD22206 | - | G97A | 1.48E-07 | 3.79E+05 | 5.60E-02 |
| 1C11_H3_L3.193 | XenD17478 | XenD22207 | - | G97S | 2.63E-07 | 3.60E+05 | 9.47E-02 |
| 1C11_H3_L3.194 | XenD17478 | XenD22208 | - | G97D | 4.62E-08 | 4.49E+05 | 2.07E-02 |
| 1C11_H3_L3.195 | XenD17478 | XenD22209 | - | G97T | 3.45E-06 | 6.12E+04 | 2.11E-01 |
| 1C11_H3_L3.196 | XenD17478 | XenD22210 | - | G97Q | 1.27E-07 | 3.19E+05 | 4.05E-02 |

FIG. 22E

| Variant Name | HC XenD | LC XenD | VH Variants | VL Variants | $K_D$ (M) | $k_a$ (1/Ms) | $k_d$ (1/s) |
|---|---|---|---|---|---|---|---|
| 1C11_H3_L3.197 | XenD17478 | XenD22211 | - | G97H | | | |
| 1C11_H3_L3.198 | XenD17478 | XenD22212 | - | G97L | 9.47E-08 | 8.29E+05 | 7.85E-02 |
| 1C11_H3_L3.199 | XenD17478 | XenD22213 | - | G97R | | | |
| 1C11_H3_L3.200 | XenD17478 | XenD22214 | - | G97F | | | |
| 1C11_H3_L3.201 | XenD17478 | XenD22215 | - | S98T | 5.22E-08 | 3.05E+05 | 1.59E-02 |
| 1C11_H3_L3.202 | XenD17478 | XenD22216 | - | S98A | 1.99E-08 | 3.89E+05 | 7.76E-03 |
| 1C11_H3_L3.203 | XenD17478 | XenD22217 | - | S98Q | 3.14E-08 | 6.06E+05 | 1.91E-02 |
| 1C11_H3_L3.204 | XenD17478 | XenD22218 | - | S98V | 1.28E-08 | 4.92E+05 | 6.30E-03 |
| 1C11_H3_L3.205 | XenD17478 | XenD22219 | - | H99Y | 5.46E-08 | 3.89E+05 | 2.13E-02 |
| 1C11_H3_L3.206 | XenD17478 | XenD22220 | - | H99Q | 4.57E-08 | 2.75E+05 | 1.26E-02 |
| 1C11_H3_L3.207 | XenD17478 | XenD22221 | - | H99D | 3.48E-08 | 3.48E+05 | 1.21E-02 |
| 1C11_H3_L3.208 | XenD17478 | XenD22222 | - | H99F | 5.16E-08 | 3.91E+05 | 2.02E-02 |
| 1C11_H3_L3.209 | XenD17478 | XenD22223 | - | H99T | 2.93E-08 | 4.26E+05 | 1.25E-02 |

FIG. 23

| Variant Name | HC XenD | LC XenD | VH Variants | VL Variants | $K_D$ (M) | $k_a$ (1/Ms) | $k_d$ (1/s) |
|---|---|---|---|---|---|---|---|
| 1C11_H3.244_L3 | XenD22099 | XenD17482 | G26T | - | 6.48E-08 | 4.54E+05 | 2.94E-02 |
| 1C11_H3.249_L3 | XenD22104 | XenD17482 | Y27D | - | 6.00E-08 | 4.91E+05 | 2.95E-02 |
| 1C11_H3.250_L3 | XenD22105 | XenD17482 | Y27K | - | 3.16E-07 | 3.65E+05 | 1.15E-01 |
| 1C11_H3.256_L3 | XenD22111 | XenD17482 | F29W | - | 2.95E-08 | 3.07E+05 | 9.05E-03 |
| 1C11_H3.258_L3 | XenD22113 | XenD17482 | T30V | - | 2.53E-08 | 4.16E+05 | 1.05E-02 |
| 1C11_H3.288_L3 | XenD22143 | XenD17482 | Y56H | - | 1.95E-08 | 4.18E+05 | 8.16E-03 |
| 1C11_H3.292_L3 | XenD22147 | XenD17482 | T59S | - | 2.02E-08 | 3.34E+05 | 6.75E-03 |
| 1C11_H3.303_L3 | XenD22158 | XenD17482 | Y111F | - | 1.48E-08 | 3.60E+05 | 5.34E-03 |
| 1C11_H3_L3.149 | XenD17478 | XenD22163 | - | H31Y | 7.35E-09 | 6.55E+05 | 4.82E-03 |
| 1C11_H3_L3.152 | XenD17478 | XenD22166 | - | H31F | 6.27E-09 | 4.55E+05 | 2.85E-03 |
| 1C11_H3_L3.160 | XenD17478 | XenD22174 | - | N33H | 4.29E-07 | 1.95E+05 | 8.37E-02 |
| 1C11_H3_L3.161 | XenD17478 | XenD22175 | - | N33E | 3.33E-07 | 3.51E+05 | 1.17E-01 |
| 1C11_H3_L3.166 | XenD17478 | XenD22180 | - | G34S | 3.14E-08 | 4.25E+05 | 1.34E-02 |
| 1C11_H3_L3.168 | XenD17478 | XenD22182 | - | G34Q | 3.18E-08 | 4.57E+05 | 1.45E-02 |
| 1C11_H3_L3.180 | XenD17478 | XenD22194 | - | Y55L | 1.14E-07 | 3.64E+05 | 4.13E-02 |
| 1C11_H3_L3.186 | XenD17478 | XenD22200 | - | N59D | 6.14E-08 | 4.25E+05 | 2.61E-02 |
| 1C11_H3_L3.191 | XenD17478 | XenD22205 | - | F95E | 5.89E-08 | 4.40E+05 | 2.59E-02 |
| 1C11_H3_L3.194 | XenD17478 | XenD22208 | - | G97D | 1.04E-07 | 2.44E+05 | 2.54E-02 |
| 1C11_H3_L3.202 | XenD17478 | XenD22216 | - | S98A | 2.64E-08 | 3.69E+05 | 9.74E-03 |
| 1C11_H3_L3.204 | XenD17478 | XenD22218 | - | S98V | 2.97E-08 | 3.86E+05 | 1.15E-02 |
| 1C11_H3_L3.207 | XenD17478 | XenD22221 | - | H99D | 3.14E-08 | 2.94E+05 | 9.23E-03 |

FIG. 24A

>XENP026917 1C11[PD-1]_H3.244_L3_IgG1_PVA_/S267K Heavy Chain (SEQ ID NOS 42274-42278)
QIQLVQSGSELKKPGASVKVSCKASTYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026917 1C11[PD-1]_H3.244_L3_IgG1_PVA_/S267K Light Chain (SEQ ID NOS 42279-42283)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP026918 1C11[PD-1]_H3.249_L3_IgG1_PVA_/S267K Heavy Chain (SEQ ID NOS 42284-42288)
QIQLVQSGSELKKPGASVKVSCKASGDTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026918 1C11[PD-1]_H3.249_L3_IgG1_PVA_/S267K Light Chain (SEQ ID NOS 42289-42293)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP026919 1C11[PD-1]_H3.250_L3_IgG1_PVA_/S267K Heavy Chain (SEQ ID NOS 42294-42298)
QIQLVQSGSELKKPGASVKVSCKASGKTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026919 1C11[PD-1]_H3.250_L3_IgG1_PVA_/S267K Light Chain (SEQ ID NOS 42299-42303)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP026920 1C11[PD-1]_H3.256_L3_IgG1_PVA_/S267K Heavy Chain (SEQ ID NOS 42304-42308)
QIQLVQSGSELKKPGASVKVSCKASGYTWTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026920 1C11[PD-1]_H3.256_L3_IgG1_PVA_/S267K Light Chain (SEQ ID NOS 42309-42313)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

FIG. 24B

>XENP026921 1C11[PD-1]_H3.258_L3_IgG1_PVA_/S267K Heavy Chain (SEQ ID NOS 42314-42318)
QIQLVQSGSELKKPGASVKVSCKASGYTFVHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026921 1C11[PD-1]_H3.258_L3_IgG1_PVA_/S267K Light Chain (SEQ ID NOS 42319-42323)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP026922 1C11[PD-1]_H3.288_L3_IgG1_PVA_/S267K Heavy Chain (SEQ ID NOS 42324-42328)
QIQLVQSGSELKKPGASVKVSCKASGYTFTHYGMNWVRQAPGQGLEWMGWINTHTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026922 1C11[PD-1]_H3.288_L3_IgG1_PVA_/S267K Light Chain (SEQ ID NOS 42329-42333)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP026923 1C11[PD-1]_H3.292_L3_IgG1_PVA_/S267K Heavy Chain (SEQ ID NOS 42334-42338)
QIQLVQSGSELKKPGASVKVSCKASGYTFTHYGMNWVRQAPGQGLEWMGWINTYSGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026923 1C11[PD-1]_H3.292_L3_IgG1_PVA_/S267K Light Chain (SEQ ID NOS 42339-42343)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP026924 1C11[PD-1]_H3.303_L3_IgG1_PVA_/S267K Heavy Chain (SEQ ID NOS 42344-42348)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYFGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026924 1C11[PD-1]_H3.303_L3_IgG1_PVA_/S267K Light Chain (SEQ ID NOS 42349-42353)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

FIG. 24C

>XENP026925 1C11[PD-1]_H3_L3.149_IgG1_PVA_/S267K Heavy Chain (SEQ ID NOS 42354-42358)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026925 1C11[PD-1]_H3_L3.149_IgG1_PVA_/S267K Light Chain (SEQ ID NOS 42359-42363)
DVLMTQSPDSLAVSLGERATINCKSSQSIVYSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP026926 1C11[PD-1]_H3_L3.152_IgG1_PVA_/S267K Heavy Chain (SEQ ID NOS 42364-42368)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026926 1C11[PD-1]_H3_L3.152_IgG1_PVA_/S267K Light Chain (SEQ ID NOS 42369-42373)
DVLMTQSPDSLAVSLGERATINCKSSQSIVFSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP026927 1C11[PD-1]_H3_L3.160_IgG1_PVA_/S267K Heavy Chain (SEQ ID NOS 42374-42378)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026927 1C11[PD-1]_H3_L3.160_IgG1_PVA_/S267K Light Chain (SEQ ID NOS 42379-42383)
DVLMTQSPDSLAVSLGERATINCKSSQSIVHSHGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP026928 1C11[PD-1]_H3_L3.161_IgG1_PVA_/S267K Heavy Chain (SEQ ID NOS 42384-42388)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026928 1C11[PD-1]_H3_L3.161_IgG1_PVA_/S267K Light Chain (SEQ ID NOS 42389-42393)
DVLMTQSPDSLAVSLGERATINCKSSQSIVHSEGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

FIG. 24D

>XENP026929 1C11[PD-1]_H3_L3.166_IgG1_PVA_/S267K Heavy Chain (SEQ ID NOS 42394-42398)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026929 1C11[PD-1]_H3_L3.166_IgG1_PVA_/S267K Light Chain (SEQ ID NOS 42399-42403)
DVLMTQSPDSLAVSLGERATINCKSSQSIVHSNSNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP026930 1C11[PD-1]_H3_L3.168_IgG1_PVA_/S267K Heavy Chain (SEQ ID NOS 42404-42408)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026930 1C11[PD-1]_H3_L3.168_IgG1_PVA_/S267K Light Chain (SEQ ID NOS 42409-42413)
DVLMTQSPDSLAVSLGERATINCKSSQSIVHSNQNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP026931 1C11[PD-1]_H3_L3.180_IgG1_PVA_/S267K Heavy Chain (SEQ ID NOS 42414-42418)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026931 1C11[PD-1]_H3_L3.180_IgG1_PVA_/S267K Light Chain (SEQ ID NOS 42419-42423)
DVLMTQSPDSLAVSLGERATINCKSSQSIVHSNGNTYLEWYQQKPGQSPKLLILKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP026932 1C11[PD-1]_H3_L3.186_IgG1_PVA_/S267K Heavy Chain (SEQ ID NOS 42424-42428)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026932 1C11[PD-1]_H3_L3.186_IgG1_PVA_/S267K Light Chain (SEQ ID NOS 42429-42433)
DVLMTQSPDSLAVSLGERATINCKSSQSIVHSNGNTYLEWYQQKPGQSPKLLIYKVSDRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

FIG. 24E

>XENP026933 1C11[PD-1]_H3_L3.191_IgG1_PVA_/S267K Heavy Chain (SEQ ID NOS 42434-42438)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026933 1C11[PD-1]_H3_L3.191_IgG1_PVA_/S267K Light Chain (SEQ ID NOS 42439-42443)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCEQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP026934 1C11[PD-1]_H3_L3.194_IgG1_PVA_/S267K Heavy Chain (SEQ ID NOS 42444-42448)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026934 1C11[PD-1]_H3_L3.194_IgG1_PVA_/S267K Light Chain (SEQ ID NOS 42449-42453)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQDSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP026935 1C11[PD-1]_H3_L3.202_IgG1_PVA_/S267K Heavy Chain (SEQ ID NOS 42454-42458)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026935 1C11[PD-1]_H3_L3.202_IgG1_PVA_/S267K Light Chain (SEQ ID NOS 42459-42463)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGAHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP026936 1C11[PD-1]_H3_L3.204_IgG1_PVA_/S267K Heavy Chain (SEQ ID NOS 42464-42468)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026936 1C11[PD-1]_H3_L3.204_IgG1_PVA_/S267K Light Chain (SEQ ID NOS 42469-42473)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGVHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

FIG. 24F

>XENP026937 1C11[PD-1]_H3_L3.207_IgG1_PVA_/S267K Heavy Chain (SEQ ID NOS 42474-42478)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026937 1C11[PD-1]_H3_L3.207_IgG1_PVA_/S267K Light Chain (SEQ ID NOS 42479-42483)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSDVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP026938 1C11[PD-1]_H3.308_L3.152_IgG1_PVA_/S267K Heavy Chain (SEQ ID NOS 42484-42488)
QIQLVQSGSELKKPGASVKVSCKASGYTFTHYGMNWVRQAPGQGLEWMGWINTYTSEPTYADGFTGRFVFSLDTSQS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026938 1C11[PD-1]_H3.308_L3.152_IgG1_PVA_/S267K Light Chain (SEQ ID NOS 42489-42493)
DVLMTQSPDSLAVSLGERATINCKSSQSIVFSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP026939 1C11[PD-1]_H3.59_L3.152_IgG1_PVA_/S267K Heavy Chain (SEQ ID NOS 42494-42498)
QIQLVQSGSELKKPGASVKVSCKASGYTFTHYGMNWVRQAPGQGLEWMGWINTYTGEPTYADGFTGRFVFSLDTSQS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026939 1C11[PD-1]_H3.59_L3.152_IgG1_PVA_/S267K Light Chain (SEQ ID NOS 42499-42503)
DVLMTQSPDSLAVSLGERATINCKSSQSIVFSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP026940 1C11[PD-1]_H3.303_L3.152_IgG1_PVA_/S267K Heavy Chain (SEQ ID NOS 42504-42508)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYFGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026940 1C11[PD-1]_H3.303_L3.152_IgG1_PVA_/S267K Light Chain (SEQ ID NOS 42509-42513)
DVLMTQSPDSLAVSLGERATINCKSSQSIVFSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

FIG. 24G

>XENP026941 1C11[PD-1]_H3.308_L3.180_IgG1_PVA_/S267K Heavy Chain (SEQ ID NOS 42514-42518)
QIQLVQSGSELKKPGASVKVSCKASGYTFTHYGMNWVRQAPGQGLEWMGWINTYTSEPTYADGFTGRFVFSLDTSQS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026941 1C11[PD-1]_H3.308_L3.180_IgG1_PVA_/S267K Light Chain (SEQ ID NOS 42519-42523)
DVLMTQSPDSLAVSLGERATINCKSSQSIVHSNGNTYLEWYQQKPGQSPKLLILKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP026942 1C11[PD-1]_H3.59_L3.180_IgG1_PVA_/S267K Heavy Chain (SEQ ID NOS 42524-42528)
QIQLVQSGSELKKPGASVKVSCKASGYTFTHYGMNWVRQAPGQGLEWMGWINTYTGEPTYADGFTGRFVFSLDTSQS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026942 1C11[PD-1]_H3.59_L3.180_IgG1_PVA_/S267K Light Chain (SEQ ID NOS 42529-42533)
DVLMTQSPDSLAVSLGERATINCKSSQSIVHSNGNTYLEWYQQKPGQSPKLLILKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP026943 1C11[PD-1]_H3.303_L3.180_IgG1_PVA_/S267K Heavy Chain (SEQ ID NOS 42534-42538)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYFGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026943 1C11[PD-1]_H3.303_L3.180_IgG1_PVA_/S267K Light Chain (SEQ ID NOS 42539-42543)
DVLMTQSPDSLAVSLGERATINCKSSQSIVHSNGNTYLEWYQQKPGQSPKLLILKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP026944 1C11[PD-1]_H3.303_L3.210_IgG1_PVA_/S267K Heavy Chain (SEQ ID NOS 42544-42548)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYFGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026944 1C11[PD-1]_H3.303_L3.210_IgG1_PVA_/S267K Light Chain (SEQ ID NOS 42549-42553)
DILMTQSPDSLAVSLGERATINCKSSQSIVHSNGNNYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

FIG. 24H

>XENP026945 1C11[PD-1]_H3.308_L3_IgG1_PVA_/S267K Heavy Chain (SEQ ID NOS 42554-42558)
QIQLVQSGSELKKPGASVKVSCKASGYTFTHYGMNWVRQAPGQGLEWMGWINTYTSEPTYADGFTGRFVFSLDTSQS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026945 1C11[PD-1]_H3.308_L3_IgG1_PVA_/S267K Light Chain (SEQ ID NOS 42559-42563)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP026946 1C11[PD-1]_H3.59_L3_IgG1_PVA_/S267K Heavy Chain (SEQ ID NOS 42564-42568)
QIQLVQSGSELKKPGASVKVSCKASGYTFTHYGMNWVRQAPGQGLEWMGWINTYTGEPTYADGFTGRFVFSLDTSQS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026946 1C11[PD-1]_H3.59_L3_IgG1_PVA_/S267K Light Chain (SEQ ID NOS 42569-42573)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP026947 1C11[PD-1]_H3.135_L3_IgG1_PVA_/S267K Heavy Chain (SEQ ID NOS 42574-42578)
QIQLVQSGSELKKPGASVKVSCKASGYTFTHYGMNWVRQAPGQGLEWMGWINTYTSEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026947 1C11[PD-1]_H3.135_L3_IgG1_PVA_/S267K Light Chain (SEQ ID NOS 42579-42583)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP026949 1C11[PD-1]_H3.308_L3.210_IgG1_PVA_/S267K Heavy Chain (SEQ ID NOS 42584-42588)
QIQLVQSGSELKKPGASVKVSCKASGYTFTHYGMNWVRQAPGQGLEWMGWINTYTSEPTYADGFTGRFVFSLDTSQS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026949 1C11[PD-1]_H3.308_L3.210_IgG1_PVA_/S267K Light Chain (SEQ ID NOS 42589-42593)
DILMTQSPDSLAVSLGERATINCKSSQSIVHSNGNNYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

FIG. 24I

>XENP026950 1C11[PD-1]_H3_L3.210_IgG1_PVA_/S267K Heavy Chain (SEQ ID NOS 42594-42598)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026950 1C11[PD-1]_H3_L3.210_IgG1_PVA_/S267K Light Chain (SEQ ID NOS 42599-42603)
DILMTQSPDSLAVSLGERATINCKSSQSIVHSNGNNYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP026951 1C11[PD-1]_H3_L3.1_IgG1_PVA_/S267K Heavy Chain (SEQ ID NOS 42604-42608)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026951 1C11[PD-1]_H3_L3.1_IgG1_PVA_/S267K Light Chain (SEQ ID NOS 42609-42613)
DILMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP026952 1C11[PD-1]_H3_L3.38_IgG1_PVA_/S267K Heavy Chain (SEQ ID NOS 42614-42618)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026952 1C11[PD-1]_H3_L3.38_IgG1_PVA_/S267K Light Chain (SEQ ID NOS 42619-42623)
DVLMTQSPDSLAVSLGERATINCKSSQSIVHSNGNNYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP026953 1C11[PD-1]_H3_L3.125_IgG1_PVA_/S267K Heavy Chain (SEQ ID NOS 42624-42628)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026953 1C11[PD-1]_H3_L3.125_IgG1_PVA_/S267K Light Chain (SEQ ID NOS 42629-42633)
DVLMTQSPDSLAVSLGERATINCKSSQSIVHSNGNTYLEWYQQKPGQSPKLLIYKVSNRFSGVPDRFSGSGSGTDFT
LTISSVEAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

FIG. 24J

>XENP026954 1C11[PD-1]_H3.308_L3.38_IgG1_PVA_/S267K Heavy Chain (SEQ ID NOS 42634-42638)
QIQLVQSGSELKKPGASVKVSCKASGYTFTHYGMNWVRQAPGQGLEWMGWINTYTSEPTYADGFTGRFVFSLDTSQS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026954 1C11[PD-1]_H3.308_L3.38_IgG1_PVA_/S267K Light Chain (SEQ ID NOS 42639-42643)
DVLMTQSPDSLAVSLGERATINCKSSQSIVHSNGNNYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP026955 1C11[PD-1]_H3.59_L3.210_IgG1_PVA_/S267K Heavy Chain (SEQ ID NOS 42644-42648)
QIQLVQSGSELKKPGASVKVSCKASGYTFTHYGMNWVRQAPGQGLEWMGWINTYTGEPTYADGFTGRFVFSLDTSQS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP026955 1C11[PD-1]_H3.59_L3.210_IgG1_PVA_/S267K Light Chain (SEQ ID NOS 42649-42653)
DILMTQSPDSLAVSLGERATINCKSSQSIVHSNGNNYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

FIG. 25

| XENP | Variant Name | K_D (M) | k_a (1/Ms) | k_d (1/s) |
|---|---|---|---|---|
| 22553 | 1C11_H3L3 | 2.98E-08 | 3.70E+05 | 1.10E-02 |
| 26322 | 1C11_H3.59_L3.38 | 1.27E-08 | 3.13E+05 | 3.99E-03 |
| 26917 | 1C11_H3.244_L3 | 6.48E-08 | 4.54E+05 | 2.94E-02 |
| 26918 | 1C11_H3.249_L3 | 6.00E-08 | 4.91E+05 | 2.95E-02 |
| 26919 | 1C11_H3.250_L3 | 3.16E-07 | 3.65E+05 | 1.15E-01 |
| 26920 | 1C11_H3.256_L3 | 2.95E-08 | 3.07E+05 | 9.05E-03 |
| 26921 | 1C11_H3.258_L3 | 2.53E-08 | 4.16E+05 | 1.05E-02 |
| 26922 | 1C11_H3.288_L3 | 1.95E-08 | 4.18E+05 | 8.16E-03 |
| 26923 | 1C11_H3.292_L3 | 2.02E-08 | 3.34E+05 | 6.75E-03 |
| 26924 | 1C11_H3.303_L3 | 1.48E-08 | 3.60E+05 | 5.34E-03 |
| 26925 | 1C11_H3_L3.149 | 7.35E-09 | 6.55E+05 | 4.82E-03 |
| 26926 | 1C11_H3_L3.152 | 6.27E-09 | 4.55E+05 | 2.85E-03 |
| 26927 | 1C11_H3_L3.160 | 4.29E-07 | 1.95E+05 | 8.37E-02 |
| 26928 | 1C11_H3_L3.161 | 3.33E-07 | 3.51E+05 | 1.17E-01 |
| 26929 | 1C11_H3_L3.166 | 3.14E-08 | 4.25E+05 | 1.34E-02 |
| 26930 | 1C11_H3_L3.168 | 3.18E-08 | 4.57E+05 | 1.45E-02 |
| 26931 | 1C11_H3_L3.180 | 1.14E-07 | 3.64E+05 | 4.13E-02 |
| 26932 | 1C11_H3_L3.186 | 6.14E-08 | 4.25E+05 | 2.61E-02 |
| 26933 | 1C11_H3_L3.191 | 5.89E-08 | 4.40E+05 | 2.59E-02 |
| 26934 | 1C11_H3_L3.194 | 1.04E-07 | 2.44E+05 | 2.54E-02 |
| 26935 | 1C11_H3_L3.202 | 2.64E-08 | 3.69E+05 | 9.74E-03 |
| 26936 | 1C11_H3_L3.204 | 2.97E-08 | 3.86E+05 | 1.15E-02 |
| 26937 | 1C11_H3_L3.207 | 3.14E-08 | 2.94E+05 | 9.23E-03 |
| 26938 | 1C11_H3.308_L3.152 | 1.42E-08 | 1.79E+05 | 2.53E-03 |
| 26939 | 1C11_H3.59_L3.152 | 1.56E-08 | 4.02E+05 | 6.25E-03 |
| 26940 | 1C11_H3.303_L3.152 | 3.41E-09 | 5.18E+05 | 1.77E-03 |
| 26941 | 1C11_H3.308_L3.180 | 4.34E-08 | 4.97E+05 | 2.16E-02 |
| 26942 | 1C11_H3.59_L3.180 | 5.74E-08 | 4.45E+05 | 2.55E-02 |
| 26943 | 1C11_H3.303_L3.180 | 4.20E-08 | 3.53E+05 | 1.48E-02 |
| 26944 | 1C11_H3.303_L3.210 | 1.04E-08 | 4.14E+05 | 4.28E-03 |
| 26945 | 1C11_H3.308_L3 | 3.22E-08 | 4.00E+05 | 1.29E-02 |
| 26946 | 1C11_H3.59_L3 | 3.71E-08 | 4.90E+05 | 1.81E-02 |
| 26947 | 1C11_H3.135_L3 | 4.76E-08 | 3.75E+05 | 1.79E-02 |
| 26949 | 1C11_H3.308_L3.210 | 2.37E-08 | 2.84E+05 | 6.71E-03 |
| 26950 | 1C11_H3_L3.210 | 1.98E-08 | 2.25E+05 | 4.45E-03 |
| 26951 | 1C11_H3_L3.1 | 4.71E-08 | 2.38E+05 | 1.12E-02 |
| 26952 | 1C11_H3_L3.38 | 2.85E-08 | 3.44E+05 | 9.79E-03 |
| 26953 | 1C11_H3_L3.125 | 5.60E-08 | 4.16E+05 | 2.33E-02 |
| 26954 | 1C11_H3.308_L3.38 | 2.29E-08 | 3.31E+05 | 7.58E-03 |
| 26955 | 1C11_H3.59_L3.210 | 1.98E-08 | 2.89E+05 | 5.72E-03 |

FIG. 26

| XENP | Variant | human PD-1 $K_D$ (M) | cyno PD-1 $K_D$ (M) |
|---|---|---|---|
| 21461 | Pembrolizumab_H0L0 | 4.48E-09 | 1.17E-09 |
| 16432 | Nivolumab_H0L0 | 4.46E-09 | 4.09E-09 |
| 21575 | 1C11[PD-1]_H0L0 | 8.65E-09 | 1.39E-08 |
| 22553 | 1C11[PD-1]_H3L3 | 8.35E-09 | 1.23E-08 |
| 25842 | 1C11[PD-1]_H3.241_L3.92 | 7.74E-09 | 1.30E-08 |
| 26917 | 1C11[PD-1]_H3.244_L3 | 1.19E-08 | 1.94E-08 |
| 26322 | 1C11[PD-1]_H3.59_L3.38 | 3.77E-09 | 7.73E-09 |
| 26926 | 1C11[PD-1]_H3_L3.152 | 1.69E-09 | 2.33E-09 |
| 26940 | 1C11[PD-1]_H3.303_L3.152 | 1.31E-09 | 3.00E-09 |

FIG. 28

| | XENP16432 | XENP21575 | XENP22553 | XENP25842 | XENP26322 | XENP26917 | XENP26926 | XENP26940 | PD-L1-Fc | PD-L2-Fc |
|---|---|---|---|---|---|---|---|---|---|---|
| XENP16432 | 0.0008 | 0.0553 | 0.0653 | 0.0607 | 0.132 | 0.0459 | 0.1326 | 0.1929 | -0.0025 | -0.119 |
| XENP21575 | 0.0584 | 0.0807 | 0.0025 | 0.0243 | 0.0355 | 0.0079 | 0.065 | 0.0814 | -0.326 | -0.1936 |
| XENP22553 | 0.0727 | 0.0387 | -0.0066 | -0.0015 | 0.0835 | 0.0106 | 0.0829 | 0.0944 | -0.3022 | -0.1241 |
| XENP25842 | -0.0139 | 0.0935 | 0.0539 | 0.092 | 0.1061 | 0.0052 | 0.0927 | 0.0912 | -0.2328 | -0.1453 |
| XENP26322 | -0.0127 | 0.0611 | -0.0109 | 0.0546 | 0.0272 | 0.0027 | 0.0696 | 0.0735 | -0.219 | -0.2475 |
| XENP26917 | 0.0612 | 0.0288 | 0.0871 | 0.0536 | 0.098 | 0.0973 | 0.1607 | 0.1785 | -0.1353 | -0.0908 |
| XENP26926 | 0.0433 | 0.0663 | 0.0585 | 0.0752 | 0.0562 | 0.0201 | 0.0742 | 0.0928 | 0.0126 | -0.0549 |
| XENP26940 | 0.0647 | -0.0082 | 0.0118 | 0.0841 | 0.0382 | -0.0409 | 0.0501 | 0.0553 | -0.0156 | -0.1703 |
| PD-L1-Fc | 0.7541 | 0.8013 | 0.7233 | 0.7269 | 0.723 | 0.7341 | 0.7119 | 0.7638 | 0.4631 | 0.4469 |
| PD-L2-Fc | 0.4908 | 0.5313 | 0.4743 | 0.5087 | 0.4643 | 0.519 | 0.5255 | 0.5282 | -0.2147 | 0.0984 |
| HBS-EP | 1 | 1 | 1 | 1 | 1 | 1 | 1 | 1 | 1 | 1 |

FIG. 33

XENP026842 Nivolumab_H0L0_IgG1_ PVA_/S267K/M428L/N434S Heavy Chain (SEQ ID NOS 42654-42658)

QVQLVESGGGVVQPGRSLRLDCKASGITFS<u>NSGMH</u>WVRQAPGKGLEWVA<u>VIWYDGSKRYYADSVKGRFTI</u>SRDNSKNTLFLQMNSLRAEDTAVYYCAT<u>NDDY</u>WGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHSHYTQKSLSLSPGK

XENP016432 Nivolumab_H0L0_IgG1_P PVA_/S267K/M428L/N434S Light Chain (SEQ ID NOS 42659-42663)

EIVLTQSPATLSLSPGERATLSC<u>RASQSVSSYLA</u>WYQQKPGQAPRLLIY<u>DASNRAT</u>GIPARFSGSGSGTDFTLTISSLEPEDFAVYYC<u>QQSSNWPRT</u>FGQGTKVEIK/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

FIG. 40A

>XENP27643 1C11_H3_L3.211_IgG1_PVA_/S267K
Heavy Chain (SEQ ID NOS 42664-42668)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 42669-42673)
DVLMTQSPDSLAVSLGERATINCKSSQSIVHSNGNTYLEWYQQKPGQSPELLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP27644 1C11_H3_L3.212_IgG1_PVA_/S267K
Heavy Chain (SEQ ID NOS 42674-42678)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 42679-42683)
DVLMTQSPDSLAVSLGERATINCKSSQSIVHSNGNTYLEWYQQKPGQSPQLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP27645 1C11_H3_L3.213_IgG1_PVA_/S267K
Heavy Chain (SEQ ID NOS 42684-42688)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 42689-42693)
DVLMTQSPDSLAVSLGERATINCKSSQSIVHSNGNTYLEWYQQKPGQSPTLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP27646 1C11_H3_L3.214_IgG1_PVA_/S267K
Heavy Chain (SEQ ID NOS 42694-42698)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

FIG. 40B

Light Chain (SEQ ID NOS 42699-42703)
DVLMTQSPDSLAVSLGERATINCKSSQSIVISNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP27647 1C11_H3_L3.215_IgG1_PVA_/S267K
Heavy Chain (SEQ ID NOS 42704-42708)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 42709-42713)
DVLMTQSPDSLAVSLGERATINCKSSQSIVLSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP27648 1C11_H3_L3.216_IgG1_PVA_/S267K
Heavy Chain (SEQ ID NOS 42714-42718)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 42719-42723)
DVLMTQSPDSLAVSLGERATINCKSSQSIVVSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP27649 1C11_H3_L3.217_IgG1_PVA_/S267K
Heavy Chain (SEQ ID NOS 42724-42728)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 42729-42733)
DVLMTQSPDSLAVSLGERATINCKSSQSIVFSNGNNYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

FIG. 40C

>XENP27650 1C11_H3_L3.218_IgG1_PVA_/S267K
Heavy Chain (SEQ ID NOS 42734-42738)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 42739-42743)
DVLMTQSPDSLAVSLGERATINCKSSQSIVYSNGNNYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP27651 1C11_H3_L3.219_IgG1_PVA_/S267K
Heavy Chain (SEQ ID NOS 42744-42748)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 42749-42753)
DILMTQSPDSLAVSLGERATINCKSSQSIVFSNGNNYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP27652 1C11_H3_L3.220_IgG1_PVA_/S267K
Heavy Chain (SEQ ID NOS 42754-42758)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 42759-42763)
DILMTQSPDSLAVSLGERATINCKSSQSIVYSNGNNYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP27839 1C11_H3.309_L3_IgG1_PVA_/S267K
Heavy Chain (SEQ ID NOS 42764-42768)
QIQLVQSESELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

FIG. 40D

Light Chain (SEQ ID NOS 42769-42773)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP27840 1C11_H3.310_L3_IgG1_PVA_/S267K
Heavy Chain (SEQ ID NOS 42774-42778)
QIQLVQSSSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 42779-42783)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP27841 1C11_H3.311_L3_IgG1_PVA_/S267K
Heavy Chain (SEQ ID NOS 42784-42788)
QIQLVQSVSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 42789-42793)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP27842 1C11_H3.312_L3_IgG1_PVA_/S267K
Heavy Chain (SEQ ID NOS 42794-42798)
QIQLVQSGSELTKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 42799-42803)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

FIG. 40E

>XENP27843 1C11_H3.313_L3_IgG1_PVA_/S267K
Heavy Chain (SEQ ID NOS 42804-42808)
QIQLVQSGSELQKPGASVKVSCKASGYTFT<u>HYGMN</u>WVRQAPGQGLEWMG<u>WINTYTGEPTYADGFT</u>GRFVFSLDTSVS
TAYLQISSLKAEDTAVYFCAR<u>DYYGSSPY</u>WGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 42809-42813)
DVLMTQSPDSLAVSLGERATINC<u>KSSQSIVHSNGNTYLE</u>WYQQKPGQSPKLLIY<u>KVSNRFS</u>GVPDRFSGSGSGTDFT
LTISSLQAEDVAVYYC<u>FQGSHVPNT</u>FGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP27844 1C11_H3.314_L3_IgG1_PVA_/S267K
Heavy Chain (SEQ ID NOS 42814-42818)
QIQLVQSGSELYKPGASVKVSCKASGYTFT<u>HYGMN</u>WVRQAPGQGLEWMG<u>WINTYTGEPTYADGFT</u>GRFVFSLDTSVS
TAYLQISSLKAEDTAVYFCAR<u>DYYGSSPY</u>WGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 42819-42823)
DVLMTQSPDSLAVSLGERATINC<u>KSSQSIVHSNGNTYLE</u>WYQQKPGQSPKLLIY<u>KVSNRFS</u>GVPDRFSGSGSGTDFT
LTISSLQAEDVAVYYC<u>FQGSHVPNT</u>FGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP27845 1C11_H3.315_L3_IgG1_PVA_/S267K
Heavy Chain (SEQ ID NOS 42824-42828)
QIQLVQSGSELLKPGASVKVSCKASGYTFT<u>HYGMN</u>WVRQAPGQGLEWMG<u>WINTYTGEPTYADGFT</u>GRFVFSLDTSVS
TAYLQISSLKAEDTAVYFCAR<u>DYYGSSPY</u>WGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 42829-42833)
DVLMTQSPDSLAVSLGERATINC<u>KSSQSIVHSNGNTYLE</u>WYQQKPGQSPKLLIY<u>KVSNRFS</u>GVPDRFSGSGSGTDFT
LTISSLQAEDVAVYYC<u>FQGSHVPNT</u>FGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP27846 1C11_H3.316_L3_IgG1_PVA_/S267K
Heavy Chain (SEQ ID NOS 42834-42838)
QIQLVQSGSELKKPGASVSVSCKASGYTFT<u>HYGMN</u>WVRQAPGQGLEWMG<u>WINTYTGEPTYADGFT</u>GRFVFSLDTSVS
TAYLQISSLKAEDTAVYFCAR<u>DYYGSSPY</u>WGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

FIG. 40F

Light Chain (SEQ ID NOS 42839-42843)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP27847 1C11_H3.317_L3_IgG1_PVA_/S267K
Heavy Chain (SEQ ID NOS 42844-42848)
QIQLVQSGSELKKPGASVTVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 42849-42853)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP27848 1C11_H3.318_L3_IgG1_PVA_/S267K
Heavy Chain (SEQ ID NOS 42854-42858)
QIQLVQSGSELVKPGASVTVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 42859-42863)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP27849 1C11_H3.319_L3_IgG1_PVA_/S267K
Heavy Chain (SEQ ID NOS 42864-42868)
QIQLVQSGSELKKPGASVKVSCKASGYTFTHYGMNWVRQAPGQGLEWMGWINTYTGEPTYADGFTGRFVFSLDTSQS
TAYLQISSLKAEDTAVYFCARDYFGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 42869-42873)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

FIG. 40G

>XENP27850_1C11_H3.320_L3_IgG1_PVA_/S267K
Heavy Chain (SEQ ID NOS 42874-42878)
QIQLVQSGSELKKPGASVKVSCKASGYTFTHYGMNWVRQAPGQGLEWMGWINTHTGEPTYADGFTGRFVFSLDTSVS
TAYLQISSLKAEDTAVYFCARDYFGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 42879-42883)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP27851_1C11_H3.321_L3_IgG1_PVA_/S267K
Heavy Chain (SEQ ID NOS 42884-42888)
QIQLVQSGSELKKPGASVKVSCKASGYTFTHYGMNWVRQAPGQGLEWMGWINTYSGEPTYADGFTGRFVFSLDTSVS
TAYLQISSLKAEDTAVYFCARDYFGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 42889-42893)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP27852_1C11_H3.322_L3_IgG1_PVA_/S267K
Heavy Chain (SEQ ID NOS 42894-42898)
QIQLVQSGSELKKPGASVKVSCKASGYTFTHYGMNWVRQAPGQGLEWMGWINTYTSEPTYADGFTGRFVFSLDTSVS
TAYLQISSLKAEDTAVYFCARDYFGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 42899-42903)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP27853_1C11_H3.323_L3_IgG1_PVA_/S267K
Heavy Chain (SEQ ID NOS 42904-42908)
QIQLVQSGSELKKPGASVKVSCKASGYTFTHYGMNWVRQAPGQGLEWMGWINTHSGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

FIG. 40H

Light Chain (SEQ ID NOS 42909-42913)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP27854 1C11_H3.324_L3_IgG1_PVA_/S267K
Heavy Chain (SEQ ID NOS 42914-42918)
QIQLVQSGSELKKPGASVKVSCKASGYTFTHYGMNWVRQAPGQGLEWMGWINTHSGEPTYADGFTGRFVFSLDTSVS
TAYLQISSLKAEDTAVYFCARDYFGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 42919-42923)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP27855 1C11_H3.325_L3_IgG1_PVA_/S267K
Heavy Chain (SEQ ID NOS 42924-42928)
QIQLVQSGSELKKPGASVKVSCKASGYTFTHYGMNWVRQAPGQGLEWMGWINTHSGEPTYADGFTGRFVFSLDTSQS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 42929-42933)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP27856 1C11_H3.326_L3_IgG1_PVA_/S267K
Heavy Chain (SEQ ID NOS 42934-42938)
QIQLVQSGSELKKPGASVKVSCKASGYTFTHYGMNWVRQAPGQGLEWMGWINTHSGEPTYADGFTGRFVFSLDTSQS
TAYLQISSLKAEDTAVYFCARDYFGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 42939-42943)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

FIG. 40I

>XENP27857_1C11_H3.319_L3.152_IgG1_PVA_/S267K
Heavy Chain (SEQ ID NOS 42944-42948)
QIQLVQSGSELKKPGASVKVSCKASGYTFTHYGMNWVRQAPGQGLEWMGWINTYTGEPTYADGFTGRFVFSLDTSQS
TAYLQISSLKAEDTAVYFCARDYFGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 42949-42953)
DVLMTQSPDSLAVSLGERATINCKSSQSIVFSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP27858_1C11_H3.320_L3.152_IgG1_PVA_/S267K
Heavy Chain (SEQ ID NOS 42954-42958)
QIQLVQSGSELKKPGASVKVSCKASGYTFTHYGMNWVRQAPGQGLEWMGWINTHTGEPTYADGFTGRFVFSLDTSVS
TAYLQISSLKAEDTAVYFCARDYFGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 42959-42963)
DVLMTQSPDSLAVSLGERATINCKSSQSIVFSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP27859_1C11_H3.321_L3.152_IgG1_PVA_/S267K
Heavy Chain (SEQ ID NOS 42964-42968)
QIQLVQSGSELKKPGASVKVSCKASGYTFTHYGMNWVRQAPGQGLEWMGWINTYSGEPTYADGFTGRFVFSLDTSVS
TAYLQISSLKAEDTAVYFCARDYFGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 42969-42973)
DVLMTQSPDSLAVSLGERATINCKSSQSIVFSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP27860_1C11_H3.322_L3.152_IgG1_PVA_/S267K
Heavy Chain (SEQ ID NOS 42974-42978)
QIQLVQSGSELKKPGASVKVSCKASGYTFTHYGMNWVRQAPGQGLEWMGWINTYSEPTYADGFTGRFVFSLDTSVS
TAYLQISSLKAEDTAVYFCARDYFGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

FIG. 40J

Light Chain (SEQ ID NOS 42979-42983)
DVLMTQSPDSLAVSLGERATINCKSSQSIVFSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP27861 1C11_H3.323_L3.152_IgG1_PVA_/S267K
Heavy Chain (SEQ ID NOS 42984-42988)
QIQLVQSGSELKKPGASVKVSCKASGYTFTHYGMNWVRQAPGQGLEWMGWINTHSGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 42989-42993)
DVLMTQSPDSLAVSLGERATINCKSSQSIVFSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP27862 1C11_H3.324_L3.152_IgG1_PVA_/S267K
Heavy Chain (SEQ ID NOS 42994-42998)
QIQLVQSGSELKKPGASVKVSCKASGYTFTHYGMNWVRQAPGQGLEWMGWINTHSGEPTYADGFTGRFVFSLDTSVS
TAYLQISSLKAEDTAVYFCARDYFGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 42999-43003)
DVLMTQSPDSLAVSLGERATINCKSSQSIVFSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP27863 1C11_H3.325_L3.152_IgG1_PVA_/S267K
Heavy Chain (SEQ ID NOS 43004-43008)
QIQLVQSGSELKKPGASVKVSCKASGYTFTHYGMNWVRQAPGQGLEWMGWINTHSGEPTYADGFTGRFVFSLDTSQS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43009-43013)
DVLMTQSPDSLAVSLGERATINCKSSQSIVFSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

FIG. 40K

>XENP27864_1C11_H3.326_L3.152_IgG1_PVA_/S267K
Heavy Chain (SEQ ID NOS 43014-43018)
QIQLVQSGSELKKPGASVKVSCKASGYTFTHYGMNWVRQAPGQGLEWMGWINTHSGEPTYADGFTGRFVFSLDTSQS
TAYLQISSLKAEDTAVYFCARDYFGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43019-43023)
DVLMTQSPDSLAVSLGERATINCKSSQSIVFSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP27865_1C11_H3.319_L3.220_IgG1_PVA_/S267K
Heavy Chain (SEQ ID NOS 43024-43028)
QIQLVQSGSELKKPGASVKVSCKASGYTFTHYGMNWVRQAPGQGLEWMGWINTYTGEPTYADGFTGRFVFSLDTSQS
TAYLQISSLKAEDTAVYFCARDYFGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43029-43033)
DILMTQSPDSLAVSLGERATINCKSSQSIVYSNGNNYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP27866_1C11_H3.320_L3.220_IgG1_PVA_/S267K
Heavy Chain (SEQ ID NOS 43034-43038)
QIQLVQSGSELKKPGASVKVSCKASGYTFTHYGMNWVRQAPGQGLEWMGWINTHTGEPTYADGFTGRFVFSLDTSVS
TAYLQISSLKAEDTAVYFCARDYFGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43039-43043)
DILMTQSPDSLAVSLGERATINCKSSQSIVYSNGNNYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP27867_1C11_H3.321_L3.220_IgG1_PVA_/S267K
Heavy Chain (SEQ ID NOS 43044-43048)
QIQLVQSGSELKKPGASVKVSCKASGYTFTHYGMNWVRQAPGQGLEWMGWINTYSGEPTYADGFTGRFVFSLDTSVS
TAYLQISSLKAEDTAVYFCARDYFGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

FIG. 40L

Light Chain (SEQ ID NOS 43049-43053)
DILMTQSPDSLAVSLGERATINCKSSQSIVYSNGNNYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP27868 1C11_H3.322_L3.220_IgG1_PVA_/S267K
Heavy Chain (SEQ ID NOS 43054-43058)
QIQLVQSGSELKKPGASVKVSCKASGYTFTHYGMNWVRQAPGQGLEWMGWINTYTSEPTYADGFTGRFVFSLDTSVS
TAYLQISSLKAEDTAVYFCARDYFGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43059-43063)
DILMTQSPDSLAVSLGERATINCKSSQSIVYSNGNNYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP27869 1C11_H3.323_L3.220_IgG1_PVA_/S267K
Heavy Chain (SEQ ID NOS 43064-43068)
QIQLVQSGSELKKPGASVKVSCKASGYTFTHYGMNWVRQAPGQGLEWMGWINTHSGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43069-43073)
DILMTQSPDSLAVSLGERATINCKSSQSIVYSNGNNYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP27870 1C11_H3.324_L3.220_IgG1_PVA_/S267K
Heavy Chain (SEQ ID NOS 43074-43078)
QIQLVQSGSELKKPGASVKVSCKASGYTFTHYGMNWVRQAPGQGLEWMGWINTHSGEPTYADGFTGRFVFSLDTSVS
TAYLQISSLKAEDTAVYFCARDYFGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43079-43083)
DILMTQSPDSLAVSLGERATINCKSSQSIVYSNGNNYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

FIG. 40M

>XENP27871_1C11_H3.325_L3.220_IgG1_PVA_/S267K
Heavy Chain (SEQ ID NOS 43084-43088)
QIQLVQSGSELKKPGASVKVSCKASGYTFTHYGMNWVRQAPGQGLEWMGWINTHSGEPTYADGFTGRFVFSLDTSQS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43089-43093)
DILMTQSPDSLAVSLGERATINCKSSQSIVYSNGNNYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP27872_1C11_H3.326_L3.220_IgG1_PVA_/S267K
Heavy Chain (SEQ ID NOS 43094-43098)
QIQLVQSGSELKKPGASVKVSCKASGYTFTHYGMNWVRQAPGQGLEWMGWINTHSGEPTYADGFTGRFVFSLDTSQS
TAYLQISSLKAEDTAVYFCARDYFGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43099-43103)
DILMTQSPDSLAVSLGERATINCKSSQSIVYSNGNNYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP27959_1C11_H3.303_L3.219_IgG1_PVA_/S267K
Heavy Chain (SEQ ID NOS 43104-43108)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYFGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43109-43113)
DILMTQSPDSLAVSLGERATINCKSSQSIVFSNGNNYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP27960_1C11_H3.303_L3.220_IgG1_PVA_/S267K
Heavy Chain (SEQ ID NOS 43114-43118)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYFGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

FIG. 40N

Light Chain (SEQ ID NOS 43119-43123)
DILMTQSPDSLAVSLGERATINCKSSQSIVYSNGNNYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP27961 1C11_H3.320_L3.219_IgG1_PVA_/S267K
Heavy Chain (SEQ ID NOS 43124-43128)
QIQLVQSGSELKKPGASVKVSCKASGYTFTHYGMNWVRQAPGQGLEWMGWINTHTGEPTYADGFTGRFVFSLDTSVS
TAYLQISSLKAEDTAVYFCARDYFGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43129-43133)
DILMTQSPDSLAVSLGERATINCKSSQSIVFSNGNNYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP27962 1C11_H3.323_L3.219_IgG1_PVA_/S267K
Heavy Chain (SEQ ID NOS 43134-43138)
QIQLVQSGSELKKPGASVKVSCKASGYTFTHYGMNWVRQAPGQGLEWMGWINTHSGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43139-43143)
DILMTQSPDSLAVSLGERATINCKSSQSIVFSNGNNYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP27963 1C11_H3.324_L3.219_IgG1_PVA_/S267K
Heavy Chain (SEQ ID NOS 43144-43148)
QIQLVQSGSELKKPGASVKVSCKASGYTFTHYGMNWVRQAPGQGLEWMGWINTHSGEPTYADGFTGRFVFSLDTSVS
TAYLQISSLKAEDTAVYFCARDYFGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43149-43153)
DILMTQSPDSLAVSLGERATINCKSSQSIVFSNGNNYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

FIG. 400

>XENP28024 1C11_H3.327_L3.220_IgG1_PVA_/S267K
Heavy Chain (SEQ ID NOS 43154-43158)
QIQLVQSGSELLKPGASVKVSCKASGYTFT<u>HYGMN</u>WVRQAPGQGLEWMG<u>WINTHTGEPTYADGFTG</u>RFVFSLDTSVS
TAYLQISSLKAEDTAVYFCAR<u>DYFGSSPY</u>WGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43159-43163)
DILMTQSPDSLAVSLGERATINC<u>KSSQSIVYSNGNNYLE</u>WYQQKPGQSPKLLIY<u>KVSNRFS</u>GVPDRFSGSGSGTDFT
LTISSLQAEDVAVYYC<u>FQGSHVPNT</u>FGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC >XENP28025 1C11_H3.328_L3.220_IgG1_PVA_/S267K
Heavy Chain (SEQ ID NOS 43164-43168)
QIQLVQSGSELKKPGASVSVSCKASGYTFT<u>HYGMN</u>WVRQAPGQGLEWMG<u>WINTHTGEPTYADGFTG</u>RFVFSLDTSVS
TAYLQISSLKAEDTAVYFCAR<u>DYFGSSPY</u>WGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43169-43173)
DILMTQSPDSLAVSLGERATINC<u>KSSQSIVYSNGNNYLE</u>WYQQKPGQSPKLLIY<u>KVSNRFS</u>GVPDRFSGSGSGTDFT
LTISSLQAEDVAVYYC<u>FQGSHVPNT</u>FGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC >XENP28026 1C11_H3.329_L3.220_IgG1_PVA_/S267K
Heavy Chain (SEQ ID NOS 43174-43178)
QIQLVQSGSELLKPGASVSVSCKASGYTFT<u>HYGMN</u>WVRQAPGQGLEWMG<u>WINTHTGEPTYADGFTG</u>RFVFSLDTSVS
TAYLQISSLKAEDTAVYFCAR<u>DYFGSSPY</u>WGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43179-43183)
DILMTQSPDSLAVSLGERATINC<u>KSSQSIVYSNGNNYLE</u>WYQQKPGQSPKLLIY<u>KVSNRFS</u>GVPDRFSGSGSGTDFT
LTISSLQAEDVAVYYC<u>FQGSHVPNT</u>FGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC >XENP28027 1C11_H3.330_L3.220_IgG1_PVA_/S267K
Heavy Chain (SEQ ID NOS 43184-43188)
QIQLVQSGSELLKPGASVKVSCKASGYTFT<u>HYGMN</u>WVRQAPGQGLEWMG<u>WINTHSGEPTYADGFTG</u>RFVFSLDTSVS
TAYLQISSLKAEDTAVYFCAR<u>DYYGSSPY</u>WGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

FIG. 40P

Light Chain (SEQ ID NOS 43189-43193)
DILMTQSPDSLAVSLGERATINCKSSQSIVYSNGNNYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP28028 1C11_H3.331_L3.220_IgG1_PVA_/S267K
Heavy Chain (SEQ ID NOS 43194-43198)
QIQLVQSGSELKKPGASVSVSCKASGYTFTHYGMNWVRQAPGQGLEWMGWINTHSGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43199-43203)
DILMTQSPDSLAVSLGERATINCKSSQSIVYSNGNNYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP28029 1C11_H3.332_L3.220_IgG1_PVA_/S267K
Heavy Chain (SEQ ID NOS 43204-43208)
QIQLVQSGSELLKPGASVSVSCKASGYTFTHYGMNWVRQAPGQGLEWMGWINTHSGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43209-43213)
DILMTQSPDSLAVSLGERATINCKSSQSIVYSNGNNYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP28030 1C11_H3.333_L3.220_IgG1_PVA_/S267K
Heavy Chain (SEQ ID NOS 43214-43218)
QIQLVQSGSELLKPGASVKVSCKASGYTFTHYGMNWVRQAPGQGLEWMGWINTHSGEPTYADGFTGRFVFSLDTSVS
TAYLQISSLKAEDTAVYFCARDYFGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43219-43223)
DILMTQSPDSLAVSLGERATINCKSSQSIVYSNGNNYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

FIG. 40Q

>XENP28031_1C11_H3.334_L3.220_IgG1_PVA_/S267K
Heavy Chain (SEQ ID NOS 43224-43228)
QIQLVQSGSELKKPGASVSVSCKASGYTFTHYGMNWVRQAPGQGLEWMGWINTHSGEPTYADGFTGRFVFSLDTSVS
TAYLQISSLKAEDTAVYFCARDYFGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43229-43233)
DILMTQSPDSLAVSLGERATINCKSSQSIVYSNGNNYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC >XENP28032_1C11_H3.335_L3.220_IgG1_PVA_/S267K
Heavy Chain (SEQ ID NOS 43234-43238)
QIQLVQSGSELLKPGASVSVSCKASGYTFTHYGMNWVRQAPGQGLEWMGWINTHSGEPTYADGFTGRFVFSLDTSVS
TAYLQISSLKAEDTAVYFCARDYFGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43239-43243)
DILMTQSPDSLAVSLGERATINCKSSQSIVYSNGNNYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC >XENP28033_1C11_H3.336_L3.220_IgG1_PVA_/S267K
Heavy Chain (SEQ ID NOS 43244-43248)
QIQLVQSGSELLKPGASVKVSCKASGYTFTHYGMNWVRQAPGQGLEWMGWINTYTGEPTYADGFTGRFVFSLDTSVS
TAYLQISSLKAEDTAVYFCARDYFGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43249-43253)
DILMTQSPDSLAVSLGERATINCKSSQSIVYSNGNNYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC >XENP28034_1C11_H3.337_L3.220_IgG1_PVA_/S267K
Heavy Chain (SEQ ID NOS 43254-43258)
QIQLVQSGSELKKPGASVSVSCKASGYTFTHYGMNWVRQAPGQGLEWMGWINTYTGEPTYADGFTGRFVFSLDTSVS
TAYLQISSLKAEDTAVYFCARDYFGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

FIG. 40R

Light Chain (SEQ ID NOS 43259-43263)
DILMTQSPDSLAVSLGERATINCKSSQSIVYSNGNNYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP28035 1C11_H3.338_L3.220_IgG1_PVA_/S267K
Heavy Chain (SEQ ID NOS 43264-43268)
QIQLVQSGSELLKPGASVSVSCKASGYTFTHYGMNWVRQAPGQGLEWMGWINTYTGEPTYADGFTGRFVFSLDTSVS
TAYLQISSLKAEDTAVYFCARDYFGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43269-43273)
DILMTQSPDSLAVSLGERATINCKSSQSIVYSNGNNYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP28651 1C11_H3.327_L3.152_IgG1_PVA_/S267K
Heavy Chain (SEQ ID NOS 43274-43278)
QIQLVQSGSELLKPGASVKVSCKASGYTFTHYGMNWVRQAPGQGLEWMGWINTHTGEPTYADGFTGRFVFSLDTSVS
TAYLQISSLKAEDTAVYFCARDYFGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43279-43283)
DVLMTQSPDSLAVSLGERATINCKSSQSIVFSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP28652 1C11_H3.328_L3.152_IgG1_PVA_/S267K
Heavy Chain (SEQ ID NOS 43284-43288)
QIQLVQSGSELKKPGASVSVSCKASGYTFTHYGMNWVRQAPGQGLEWMGWINTHTGEPTYADGFTGRFVFSLDTSVS
TAYLQISSLKAEDTAVYFCARDYFGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43289-43293)
DVLMTQSPDSLAVSLGERATINCKSSQSIVFSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

FIG. 40S

>XENP28653_1C11_H3.329_L3.152_IgG1_PVA_/S267K
Heavy Chain (SEQ ID NOS 43294-43298)
QIQLVQSGSELLKPGASVSVSCKASGYTFTHYGMNWVRQAPGQGLEWMGWINTHTGEPTYADGFTGRFVFSLDTSVS
TAYLQISSLKAEDTAVYFCARDYFGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43299-43303)
DVLMTQSPDSLAVSLGERATINCKSSQSIVFSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP28654_1C11_H3.23_L3_IgG1_PVA_/S267K
Heavy Chain (SEQ ID NOS 43304-43308)
QIQLVQSGSELKKPGASVKVSCKASGYTFTHYGMNWVRQAPGQGLEWMGYINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43309-43313)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP28655_1C11_H3.28_L3_IgG1_PVA_/S267K
Heavy Chain (SEQ ID NOS 43314-43318)
QIQLVQSGSELKKPGASVKVSCKASGYTFTHYGMNWVRQAPGQGLEWMGWINTYTGETTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43319-43323)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP28656_1C11_H3.35_L3_IgG1_PVA_/S267K
Heavy Chain (SEQ ID NOS 43324-43328)
QIQLVQSGSELKKPGASVKVSCKASGYTFTHYGMNWVRQAPGQGLEWMGWINTYTGEPTYADKFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

FIG. 40T

Light Chain (SEQ ID NOS 43329-43333)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP28657 1C11_H3_L3.71_IgG1_PVA_/S267K
Heavy Chain (SEQ ID NOS 43334-43338)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43339-43343)
DVLMTQSPDSLAVSLGERATINCKSSQSIVHSNGNTYLEWYQQKPGQSPKLLIYKVSNRFSGVPDRFSGSGSGTDFT
LTISSLQAEDIAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP28658 1C11_H3_L3.74_IgG1_PVA_/S267K
Heavy Chain (SEQ ID NOS 43344-43348)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43349-43353)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCQQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP28659 1C11_H3_L3.77_IgG1_PVA_/S267K
Heavy Chain (SEQ ID NOS 43354-43358)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43359-43363)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQYSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

FIG. 40U

>XENP29029_1C11_H3.246_L3_IgG1_PVA_/S267K
Heavy Chain (SEQ ID NOS 43364-43368)
QIQLVQSGSELKKPGASVKVSCKASGLTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43369-43373)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP29030_1C11_H3.247_L3_IgG1_PVA_/S267K
Heavy Chain (SEQ ID NOS 43374-43378)
QIQLVQSGSELKKPGASVKVSCKASGHTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43379-43383)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP29031_1C11_H3.248_L3_IgG1_PVA_/S267K
Heavy Chain (SEQ ID NOS 43384-43388)
QIQLVQSGSELKKPGASVKVSCKASGQTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43389-43393)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP29032_1C11_H3.254_L3_IgG1_PVA_/S267K
Heavy Chain (SEQ ID NOS 43394-43398)
QIQLVQSGSELKKPGASVKVSCKASGYQFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

FIG. 40V

Light Chain (SEQ ID NOS 43399-43403)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP29033 1C11_H3.263_L3_IgG1_PVA_/S267K
Heavy Chain (SEQ ID NOS 43404-43408)
QIQLVQSGSELKKPGASVKVSCKASGYTFTQYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43409-43413)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP29034 1C11_H3.264_L3_IgG1_PVA_/S267K
Heavy Chain (SEQ ID NOS 43414-43418)
QIQLVQSGSELKKPGASVKVSCKASGYTFTDYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43419-43423)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP29035 1C11_H3.265_L3_IgG1_PVA_/S267K
Heavy Chain (SEQ ID NOS 43424-43428)
QIQLVQSGSELKKPGASVKVSCKASGYTFTRYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43429-43433)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

FIG. 40W

>XENP29036_1C11_H3.269_L3_IgG1_PVA_/S267K
Heavy Chain (SEQ ID NOS 43434-43438)
QIQLVQSGSELKKPGASVKVSCKASGYTFTHLGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43439-43443)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP29037_1C11_H3.276_L3_IgG1_PVA_/S267K
Heavy Chain (SEQ ID NOS 43444-43448)
QIQLVQSGSELKKPGASVKVSCKASGYTFTHYGMNWFRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43449-43453)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP29038_1C11_H3.283_L3_IgG1_PVA_/S267K
Heavy Chain (SEQ ID NOS 43454-43458)
QIQLVQSGSELKKPGASVKVSCKASGYTFTHYGMNWVRQAPGQGLEWMGWIQTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43459-43463)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP29039_1C11_H3.284_L3_IgG1_PVA_/S267K
Heavy Chain (SEQ ID NOS 43464-43468)
QIQLVQSGSELKKPGASVKVSCKASGYTFTHYGMNWVRQAPGQGLEWMGWIETYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

FIG. 40X

Light Chain (SEQ ID NOS 43469-43473)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP29040 1C11_H3.285_L3_IgG1_PVA_/S267K
Heavy Chain (SEQ ID NOS 43474-43478)
QIQLVQSGSELKKPGASVKVSCKASGYTFTHYGMNWVRQAPGQGLEWMGWIHTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43479-43483)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP29041 1C11_H3.286_L3_IgG1_PVA_/S267K
Heavy Chain (SEQ ID NOS 43484-43488)
QIQLVQSGSELKKPGASVKVSCKASGYTFTHYGMNWVRQAPGQGLEWMGWISTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43489-43493)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP29042 1C11_H3.289_L3_IgG1_PVA_/S267K
Heavy Chain (SEQ ID NOS 43494-43498)
QIQLVQSGSELKKPGASVKVSCKASGYTFTHYGMNWVRQAPGQGLEWMGWINTLTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43499-43503)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

FIG. 40Y

>XENP29043_1C11_H3.290_L3_IgG1_PVA_/S267K
Heavy Chain (SEQ ID NOS 43504-43508)
QIQLVQSGSELKKPGASVKVSCKASGYTFTHYGMNWVRQAPGQGLEWMGWINTWTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43509-43513)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP29044_1C11_H3.294_L3_IgG1_PVA_/S267K
Heavy Chain (SEQ ID NOS 43514-43518)
QIQLVQSGSELKKPGASVKVSCKASGYTFTHYGMNWVRQAPGQGLEWMGWINTYIGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43519-43523)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP29045_1C11_H3.296_L3_IgG1_PVA_/S267K
Heavy Chain (SEQ ID NOS 43524-43528)
QIQLVQSGSELKKPGASVKVSCKASGYTFTHYGMNWVRQAPGQGLEWMGWINTYTGKPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43529-43533)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP29046_1C11_H3_L3.155_IgG1_PVA_/S267K
Heavy Chain (SEQ ID NOS 43534-43538)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

FIG. 40Z

Light Chain (SEQ ID NOS 43539-43543)
DVLMTQSPDSLAVSLGERATINCKSSQSIVHTNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP29047_1C11_H3_L3.157_IgG1_PVA_/S267K
Heavy Chain (SEQ ID NOS 43544-43548)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43549-43553)
DVLMTQSPDSLAVSLGERATINCKSSQSIVHQNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP29048_1C11_H3_L3.163_IgG1_PVA_/S267K
Heavy Chain (SEQ ID NOS 43554-43558)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43559-43563)
DVLMTQSPDSLAVSLGERATINCKSSQSIVHSRGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP29049_1C11_H3_L3.173_IgG1_PVA_/S267K
Heavy Chain (SEQ ID NOS 43564-43568)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43569-43573)
DVLMTQSPDSLAVSLGERATINCKSSQSIVHSNGNTFLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

FIG. 40AA

>XENP29050 1C11_H3_L3.181_IgG1_PVA_/S267K
Heavy Chain (SEQ ID NOS 43574-43578)
QIQLVQSGSELKKPGASVKVSCKASGYTFT<u>HYGMN</u>WVRQAPGQGLEWMG<u>WINTYTGEPTYADGFTGRFVFSLDTSVS
TAYLQISSLKAEDTAVYFCARDYYGSSPYW</u>GQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43579-43583)
DVLMTQSPDSLAVSLGERATINC<u>KSSQSIVHSNGNTYLE</u>WYQQKPGQSPKLLIW<u>KVSNRF</u>SGVPDRFSGSGSGTDFT
LTISSLQAEDVAVYYC<u>FQGSHVPNT</u>FGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP29051_1C11_H3_L3.182_IgG1_PVA_/S267K
Heavy Chain (SEQ ID NOS 43584-43588)
QIQLVQSGSELKKPGASVKVSCKASGYTFT<u>HYGMN</u>WVRQAPGQGLEWMG<u>WINTYTGEPTYADGFTGRFVFSLDTSVS
TAYLQISSLKAEDTAVYFCARDYYGSSPYW</u>GQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43589-43593)
DVLMTQSPDSLAVSLGERATINC<u>KSSQSIVHSNGNTYLE</u>WYQQKPGQSPKLLIQ<u>KVSNRF</u>SGVPDRFSGSGSGTDFT
LTISSLQAEDVAVYYC<u>FQGSHVPNT</u>FGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP29052_1C11_H3_L3.189_IgG1_PVA_/S267K
Heavy Chain (SEQ ID NOS 43594-43598)
QIQLVQSGSELKKPGASVKVSCKASGYTFT<u>HYGMN</u>WVRQAPGQGLEWMG<u>WINTYTGEPTYADGFTGRFVFSLDTSVS
TAYLQISSLKAEDTAVYFCARDYYGSSPYW</u>GQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43599-43603)
DVLMTQSPDSLAVSLGERATINC<u>KSSQSIVHSNGNTYLE</u>WYQQKPGQSPKLLIY<u>KVSRRF</u>SGVPDRFSGSGSGTDFT
LTISSLQAEDVAVYYC<u>FQGSHVPNT</u>FGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP29053_1C11_H3_L3.192_IgG1_PVA_/S267K
Heavy Chain (SEQ ID NOS 43604-43608)
QIQLVQSGSELKKPGASVKVSCKASGYTFT<u>HYGMN</u>WVRQAPGQGLEWMG<u>WINTYTGEPTYADGFTGRFVFSLDTSVS
TAYLQISSLKAEDTAVYFCARDYYGSSPYW</u>GQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

FIG. 40BB

Light Chain (SEQ ID NOS 43609-43613)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQASHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP29054 1C11_H3_L3.193_IgG1_PVA_/S267K
Heavy Chain (SEQ ID NOS 43614-43618)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43619-43623)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQSSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP29055 1C11_H3_L3.196_IgG1_PVA_/S267K
Heavy Chain (SEQ ID NOS 43624-43628)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43629-43633)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQQSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP29056 1C11_H3_L3.198_IgG1_PVA_/S267K
Heavy Chain (SEQ ID NOS 43634-43638)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

Light Chain (SEQ ID NOS 43639-43643)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQLSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

FIG. 41

|  | | Human PD-1 | | |
|---|---|---|---|---|
| TA | Variant | $K_D$ (M) | $k_a$ (1/Ms) | $k_d$ (1/s) |
| XENP27643 | 1C11_H3_L3.211 | 2.95E-08 | 3.57E+05 | 1.05E-02 |
| XENP27644 | 1C11_H3_L3.212 | 2.57E-08 | 3.75E+05 | 9.63E-03 |
| XENP27645 | 1C11_H3_L3.213 | 3.32E-08 | 3.16E+05 | 1.05E-02 |
| XENP27646 | 1C11_H3_L3.214 | 7.26E-08 | 4.75E+05 | 3.45E-02 |
| XENP27647 | 1C11_H3_L3.215 | 7.90E-08 | 7.89E+05 | 6.23E-02 |
| XENP27648 | 1C11_H3_L3.216 | 1.25E-07 | 7.64E+05 | 9.52E-02 |
| XENP27649 | 1C11_H3_L3.217 | 7.18E-09 | 3.81E+05 | 2.73E-03 |
| XENP27650 | 1C11_H3_L3.218 | 5.80E-09 | 3.53E+05 | 2.05E-03 |
| XENP27651 | 1C11_H3_L3.219 | 6.72E-09 | 3.40E+05 | 2.29E-03 |
| XENP27652 | 1C11_H3_L3.220 | 5.02E-09 | 3.43E+05 | 1.72E-03 |
| XENP16432 | Nivolumab_H0L0 | 1.02E-08 | 3.38E+05 | 3.43E-03 |

FIG. 42

| | | Human PD-1 | | |
|---|---|---|---|---|
| TA | Variant | $K_D$ (M) | $k_a$ (1/Ms) | $k_d$ (1/s) |
| XENP27839 | 1C11_H3.309_L3 | 4.63E-08 | 3.02E+05 | 1.40E-02 |
| XENP27840 | 1C11_H3.310_L3 | 6.02E-08 | 2.84E+05 | 1.71E-02 |
| XENP27841 | 1C11_H3.311_L3 | 5.30E-08 | 3.06E+05 | 1.62E-02 |
| XENP27842 | 1C11_H3.312_L3 | 5.07E-08 | 3.31E+05 | 1.68E-02 |
| XENP27843 | 1C11_H3.313_L3 | 4.92E-08 | 3.14E+05 | 1.54E-02 |
| XENP27844 | 1C11_H3.314_L3 | 4.93E-08 | 3.85E+05 | 1.90E-02 |
| XENP27845 | 1C11_H3.315_L3 | 3.15E-08 | 3.40E+05 | 1.07E-02 |
| XENP27846 | 1C11_H3.316_L3 | 3.77E-08 | 3.51E+05 | 1.32E-02 |
| XENP27847 | 1C11_H3.317_L3 | 5.04E-08 | 3.41E+05 | 1.72E-02 |
| XENP27848 | 1C11_H3.318_L3 | 7.16E-08 | 2.84E+05 | 2.03E-02 |
| XENP27849 | 1C11_H3.319_L3 | 2.44E-08 | 3.31E+05 | 8.07E-03 |
| XENP27850 | 1C11_H3.320_L3 | 1.60E-08 | 2.96E+05 | 4.73E-03 |
| XENP27851 | 1C11_H3.321_L3 | 1.19E-08 | 3.95E+05 | 4.70E-03 |
| XENP27852 | 1C11_H3.322_L3 | 1.91E-08 | 3.17E+05 | 6.06E-03 |
| XENP27853 | 1C11_H3.323_L3 | 1.25E-08 | 3.87E+05 | 4.81E-03 |
| XENP27854 | 1C11_H3.324_L3 | 7.17E-09 | 4.18E+05 | 3.00E-03 |
| XENP27855 | 1C11_H3.325_L3 | 1.67E-08 | 4.03E+05 | 6.74E-03 |
| XENP27856 | 1C11_H3.326_L3 | 1.16E-08 | 3.67E+05 | 4.25E-03 |
| XENP27857 | 1C11_H3.319_L3.152 | 8.51E-09 | 3.15E+05 | 2.68E-03 |
| XENP27858 | 1C11_H3.320_L3.152 | 5.66E-09 | 3.75E+05 | 2.12E-03 |
| XENP27859 | 1C11_H3.321_L3.152 | 5.60E-09 | 3.40E+05 | 1.90E-03 |
| XENP27860 | 1C11_H3.322_L3.152 | 8.41E-09 | 3.09E+05 | 2.60E-03 |
| XENP27861 | 1C11_H3.323_L3.152 | 4.39E-09 | 3.82E+05 | 1.68E-03 |
| XENP27862 | 1C11_H3.324_L3.152 | 3.46E-09 | 4.06E+05 | 1.41E-03 |
| XENP27863 | 1C11_H3.325_L3.152 | 6.61E-09 | 4.88E+05 | 3.23E-03 |
| XENP27864 | 1C11_H3.326_L3.152 | 6.12E-09 | 5.02E+05 | 3.07E-03 |
| XENP27865 | 1C11_H3.319_L3.220 | 5.46E-09 | 3.37E+05 | 1.84E-03 |
| XENP27866 | 1C11_H3.320_L3.220 | 4.13E-09 | 3.44E+05 | 1.42E-03 |
| XENP27867 | 1C11_H3.321_L3.220 | 5.89E-09 | 4.50E+05 | 2.65E-03 |
| XENP27868 | 1C11_H3.322_L3.220 | 7.13E-09 | 4.00E+05 | 2.85E-03 |
| XENP27869 | 1C11_H3.323_L3.220 | 4.70E-09 | 3.86E+05 | 1.82E-03 |
| XENP27870 | 1C11_H3.324_L3.220 | 4.48E-09 | 4.26E+05 | 1.91E-03 |
| XENP27871 | 1C11_H3.325_L3.220 | 5.34E-09 | 5.44E+05 | 2.90E-03 |
| XENP27872 | 1C11_H3.326_L3.220 | 3.91E-09 | 3.78E+05 | 1.48E-03 |
| XENP22553 | 1C11_H3L3 | 6.19E-08 | 3.04E+05 | 1.88E-02 |
| XENP26940 | 1C11_H3.303_L3.152 | 7.36E-09 | 3.67E+05 | 2.70E-03 |

FIG. 43

| | | Human PD-1 | | |
|---|---|---|---|---|
| TA | Variant | $K_D$ (M) | $k_a$ (1/Ms) | $k_d$ (1/s) |
| XENP22553 | 1C11_H3L3 | 1.54E-08 | 3.17E+05 | 4.87E-03 |
| XENP26940 | 1C11_H3.303_L3.152 | 6.74E-09 | 2.57E+05 | 1.73E-03 |
| XENP27858 | 1C11_H3.320_L3.152 | 3.07E-09 | 3.23E+05 | 9.91E-04 |
| XENP27861 | 1C11_H3.323_L3.152 | 4.14E-09 | 4.74E+05 | 1.97E-03 |
| XENP27862 | 1C11_H3.324_L3.152 | 4.48E-09 | 3.25E+05 | 1.46E-03 |
| XENP27959 | 1C11_H3.303_L3.219 | 3.58E-09 | 2.56E+05 | 9.14E-04 |
| XENP27960 | 1C11_H3.303_L3.220 | 2.30E-09 | 2.47E+05 | 5.68E-04 |
| XENP27961 | 1C11_H3.320_L3.219 | 2.75E-09 | 3.28E+05 | 9.01E-04 |
| XENP27962 | 1C11_H3.323_L3.219 | 2.32E-09 | 3.60E+05 | 8.34E-04 |
| XENP27963 | 1C11_H3.324_L3.219 | 2.96E-09 | 3.71E+05 | 1.10E-03 |

FIG. 44

|  | | Human PD-1 | | |
| --- | --- | --- | --- | --- |
| TA | Variant | $K_D$ (M) | $k_a$ (1/Ms) | $k_d$ (1/s) |
| XENP28024 | 1C11_H3.327_L3.220 | 1.39E-09 | 2.35E+05 | 3.25E-04 |
| XENP28025 | 1C11_H3.328_L3.220 | 1.85E-09 | 2.17E+05 | 4.02E-04 |
| XENP28026 | 1C11_H3.329_L3.220 | 1.78E-09 | 2.50E+05 | 4.45E-04 |
| XENP28027 | 1C11_H3.330_L3.220 | 2.18E-09 | 3.03E+05 | 6.61E-04 |
| XENP28028 | 1C11_H3.331_L3.220 | 2.15E-09 | 3.42E+05 | 7.35E-04 |
| XENP28029 | 1C11_H3.332_L3.220 | 2.57E-09 | 2.94E+05 | 7.56E-04 |
| XENP28030 | 1C11_H3.333_L3.220 | 2.37E-09 | 2.71E+05 | 6.44E-04 |
| XENP28031 | 1C11_H3.334_L3.220 | 2.43E-09 | 2.56E+05 | 6.21E-04 |
| XENP28032 | 1C11_H3.335_L3.220 | 2.11E-09 | 2.45E+05 | 5.18E-04 |
| XENP28033 | 1C11_H3.336_L3.220 | 5.29E-09 | 1.79E+05 | 9.50E-04 |
| XENP28034 | 1C11_H3.337_L3.220 | 2.92E-09 | 2.82E+05 | 8.23E-04 |
| XENP28035 | 1C11_H3.338_L3.220 | 5.54E-09 | 2.55E+05 | 1.41E-03 |
| XENP22553 | 1C11_H3L3 | 1.80E-08 | 2.13E+05 | 3.82E-03 |
| XENP26940 | 1C11_H3.303_L3.152 | 5.18E-09 | 1.41E+05 | 7.28E-04 |
| XENP27960 | 1C11_H3.303_L3.220 | 3.35E-09 | 2.45E+05 | 8.19E-04 |
| XENP27866 | 1C11_H3.320_L3.220 | 3.26E-09 | 3.67E+05 | 1.20E-03 |
| XENP27869 | 1C11_H3.323_L3.220 | 4.13E-09 | 2.55E+05 | 1.05E-03 |
| XENP27870 | 1C11_H3.324_L3.220 | 7.56E-09 | 2.41E+05 | 1.82E-03 |
| XENP27959 | 1C11_H3.303_L3.219 | 6.47E-09 | 1.82E+05 | 1.17E-03 |
| XENP27961 | 1C11_H3.320_L3.219 | 4.22E-09 | 2.60E+05 | 1.10E-03 |
| XENP27962 | 1C11_H3.323_L3.219 | 4.58E-09 | 3.95E+05 | 1.81E-03 |
| XENP27963 | 1C11_H3.324_L3.219 | 4.63E-09 | 2.73E+05 | 1.27E-03 |

FIG. 45

|  |  | Human PD-1 | | | Cynomolgus PD-1 | | |
| --- | --- | --- | --- | --- | --- | --- | --- |
| TA | Variant | KD (M) | ka (1/Ms) | kd (1/s) | KD (M) | ka (1/Ms) | kd (1/s) |
| XENP28651 | 1C11_H3.327_L3.152 | 4.14E-09 | 2.03E+05 | 8.41E-04 | 5.23E-09 | 3.38E+05 | 1.77E-03 |
| XENP28652 | 1C11_H3.328_L3.152 | 7.74E-09 | 1.77E+05 | 1.37E-03 | 1.10E-08 | 2.63E+05 | 2.89E-03 |
| XENP28653 | 1C11_H3.329_L3.152 | 4.95E-09 | 1.93E+05 | 9.55E-04 | 7.78E-09 | 3.59E+05 | 2.79E-03 |

FIG. 49A

XenCS500: PD-1 X ICOS

[ICOS]_H0L0_Fab-1C11[PD-1]_H3.234_L3.144-scFv(GKPGS)4-IgG1_pI(-)_Isosteric_A_/PVA_/S267K/L368D/K370S-Fc(216)_IgG1_C220S/PVA_/S267K/S364K/E357Q Fab Chain 1 – [ICOS]_H0_ IgG1_pI(-)_Isosteric_A_/PVA_/S267K/L368D/K370S (SEQ ID NOS 43644-43648)

QVQLVQSGAEVKKPGASVKVSCKASGYTFTGYYMHWVRQAPGQGLEWMGWINPHSGGTNYAQKFQGRVTMTRDTSISTAYME
LSRLRSDDTAVYYCARTYYYDSSGYYHDAFDIWGQGTMVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVV
VDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQ
VSLTCDVSGFYPSDIAVEWESDGQPENNYKTTPPVLDSDGSFFLYSKLTVDKSRWEQGDVFSCSVMHEALHNHYTQKSLSLSPGK

VH ICOS H0L0 (SEQ ID NOS 43645-43648)
QVQLVQSGAEVKKPGASVKVSCKASGYTFTGYYMHWVRQAPGQGLEWMGWINPHSGGTNYAQKFQGRVTMTRDTSISTAYME
LSRLRSDDTAVYYCARTYYYDSSGYYHDAFDIWGQGTMVTVSS scFv Chain 2 – 1C11[PD-1]_H3.234_L3.144_scFv(GKPGS)4_Fc(216)_IgG1_C220S/PVA_/S267K/S364K/E357Q (SEQ ID NOS 43649-43658 and linker disclosed as SEQ ID NO: 39202)

EVQLVQSGSELKKPGESVKVSCKASGYTFTHYGINWVRQPPGQGLEWMGWINTYTGEPYYAPGFQERFVFSLDTSQDTAYLQ
INSLKAEDTAVYYCARDYYGSSPYWGQGTLVTVSS/GKPGSGKPGSGKPGSGKPGS/DIVMTQSPDSLAVSLGERVTINCKA
SQSIVHSNGNTYLEWYQQKPGQPPKLLIYKVSNRFSGVPDRFSGSGSGTDFTLTISSVEAEDAATYYCFQGSHVPNTFGQGT
KVEIK/EPKSSDKTHTCPPCPAPPVAGPSVFLFPPKPKDTLMISRTPEVTCVVVDVKHEDPEVKFNWYVDGVEVHNAKTKPR
EEQYNSTYRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK

Light Chain 3 – [ICOS]_L0 (SEQ ID NOS 43659-43663)

DIQMTQSPSSVSASVGDRVTITCRASQGISRLLAWYQQKPGKAPKLLIYVASSLQSGVPSRFSGSGSGTDFTLTISSLQPED
FATYYCQQANSFPWTFGQGTKVEIK/RTVAAPSVFIFPPSDEQLKSGTASVVCLLNNFYPREAKVQWKVDNALQSGNSQESV
TEQDSKDSTYSLSSTLTLSKADYEKHKVYACEVTHQGLSSPVTKSFNRGEC

VL ICOS H0L0 (SEQ ID NOS 43660-43663)
DIQMTQSPSSVSASVGDRVTITCRASQGISRLLAWYQQKPGKAPKLLIYVASSLQSGVPSRFSGSGSGTDFTLTISSLQPED
FATYYCQQANSFPWTFGQGTKVEIK

XenCS501: PD-1 X ICOS
> [ICOS]_H0.66_L0_Fab-1C11[PD-1]_H3.234_L3.144-scFv(GKPGS)4-IgG1_pI(-)_Isosteric_A_/PVA_/S267K/L368D/K370S-Fc(216)_IgG1_C220S/PVA_/S267K/S364K/E357Q Fab Chain 1 – [ICOS]_H0.66_ IgG1_pI(-)_Isosteric_A_/PVA_/S267K/L368D/K370S (SEQ ID NOS 43664-43668)

QVQLVQSGAEVKKPGASVKVSCKASGYTFTGYYMHWVRQAPGQGLEWMGWINPHSGETIYAQKFQGRVTMTRDTSISTAYME
LSSLRSEDTAVYYCARTYYYDTSGYYHDAFDVWGQGTMVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAPPVAGP
SVFLFPPKPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDG
SFFLYSKLTVDKSRWEQGDVFSCSVMHEALHNHYTQKSLSLSPGK

FIG. 49B

VH_ICOS_H0.66_L0 (SEQ ID NOS 43665-43668)
QVQLVQSGAEVKKPGASVKVSCKASGYTFTGYYMHWVRQAPGQGLEWMGWINPHSGETIYAQKFQGRVTMTRDTSIS
TAYMELSSLRSEDTAVYYCARTYYYDTSGYYHDAFDVWGQGTMVTVSS scFv Chain 2 – 1C11[PD-1]_H3.234_L3.144_scFv(GKPGS)4_Fc(216)_IgG1_C220S/PVA_/S267K/S364K/E357Q (SEQ ID NOS 43669-43678 and linker disclosed as SEQ ID NO: 39202)
EVQLVQSGSELKKPGESVKVSCKASGYTFTHYGINWVRQPPGQGLEWMGWINTYTGEPYYAPGFQERFVFSLDTSQD
TAYLQINSLKAEDTAVYYCARDYYGSSPYWGQGTLVTVSS/GKPGSGKPGSGKPGSGKPGS/DIVMTQSPDSLAVSL
GERVTINCKASQSIVHSNGNTYLEWYQQKPGQPPKLLIYKVSNRFSGVPDRFSGSGSGTDFTLTISSVEAEDAATYY
CFQGSHVPNTFGQGTKVEIK/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VMHEALHNHYTQKSLSLSPGK

Light Chain 3 – [ICOS]_L0 (SEQ ID NOS 43679-43683)
DIQMTQSPSSVSASVGDRVTITCRASQGISRLLAWYQQKPGKAPKLLIYVASSLQSGVPSRFSGSGSGTDFTLTISS
LQPEDFATYYCQQANSFPWTFGQGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

VL_ICOS_H0.66_L0 (SEQ ID NOS 43680-43683)
DIQMTQSPSSVSASVGDRVTITCRASQGISRLLAWYQQKPGKAPKLLIYVASSLQSGVPSRFSGSGSGTDFTLTISS
LQPEDFATYYCQQANSFPWTFGQGTKVEIK

XenCS502: PD-1 X CTLA-4

> [CTLA-4]_H3_L0.22_Fab-1C11[PD-1]_H3.234_L3.144_scFv(GKPGS)4-IgG1_pI(-)_Isosteric_A_/PVA_/S267K/L368D/K370S-Fc(216)_IgG1_C220S/PVA_/S267K/S364K/E357Q

Fab Chain 1 - [CTLA-4]_H3_IgG1_pI(-)_Isosteric_A_/PVA_/S267K/L368D/K370S (SEQ ID NOS 43684-43688)
EVQLVESGGGLVKPGGSLRLSCAASGFTFSSYTMHWVRQAPGKGLEWVSFISYDGNNKYYADSVKGRFTISRDNAKN
SLYLQMNSLRAEDTAVYYCARTGWLGPFDYWGQGTLVTVSS/ASTKGPSVFPLAPSSKSTSGGTAALGCLVKDYFPE
PVTVSWNSGALTSGVHTFPAVLQSSGLYSLSSVVTVPSSSLGTQTYICNVNHKPSDTKVDKKVEPKSCDKTHTCPPC
PAPPVAGPSVFLFPPKPKDTLMISRTPEVTCVVVDVKHEDPEVKFNWYVDGVEVHNAKTKPREEEYNSTYRVVSVLT
VLHQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK scFv Chain 2 - 1C11[PD-1]_H3.234_L3.144_scFv(GKPGS)4_Fc(216)_IgG1_C220S/PVA_/S267K/S364K/E357Q (SEQ ID NOS 43689-43698 and linker disclosed as SEQ ID NO: 39202)
EVQLVQSGSELKKPGESVKVSCKASGYTFTHYGINWVRQPPGQGLEWMGWINTYTGEPYYAPGFQERFVFSLDTSQD
TAYLQINSLKAEDTAVYYCARDYYGSSPYWGQGTLVTVSS/GKPGSGKPGSGKPGSGKPGS/DIVMTQSPDSLAVSL
GERVTINCKASQSIVHSNGNTYLEWYQQKPGQPPKLLIYKVSNRFSGVPDRFSGSGSGTDFTLTISSVEAEDAATYY
CFQGSHVPNTFGQGTKVEIK/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VMHEALHNHYTQKSLSLSPGK

FIG. 49C

Light Chain 3 - [CTLA-4]_L0.22 (SEQ ID NOS 43699-43703)
EIVLTQSPGTLSLSPGERATLSCRASQSVSSSYLAWYQQKPGQAPRLLIYGAFSRATGIPDRFSGSGSGTDFTLTIS
RLEPEDFAVYYCQQYGSSPWTFGQGTKVEIK/RTVAAPSVFIFPPSDEQLKSGTASVVCLLNNFYPREAKVQWKVDN
ALQSGNSQESVTEQDSKDSTYSLSSTLTLSKADYEKHKVYACEVTHQGLSSPVTKSFNRGEC

```
CS503: PD-1 X LAG-3
```
> 7G8_H3.30_L1.34_[LAG-3]_Fab-1C11[PD-1]_H3.234_L3.144_scFv(GKPGS)4-IgG1_pI(-)_Isosteric_A_/PVA_/S267K/L368D/K370S-Fc(216)_IgG1_C220S/PVA_/S267K/S364K/E357Q

Fab Chain 1 – 7G8_H3.30_ IgG1_pI(-)_Isosteric_A_/PVA_/S267K/L368D/K370S (SEQ ID NOS 43704-43708)
EVQLVESGGGLVQPGGSLRLSCAASGFTFDDAWMSWVRQAPGKGLEWVAEISTKANNHATYYAESVKGRFTISRDDS
KSSVYLQMNSLRAEDTAVYYCTRLATWDWYFDVWGQGTTVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK scFv Chain 2 –1C11[PD-1]_H3.234_L3.144_scFv(GKPGS)4_Fc(216)_IgG1_C220S/PVA_/S267K/S364K/E357Q (SEQ ID NOS 43709-43718 and linker disclosed as SEQ ID NO: 39202)
EVQLVQSGSELKKPGESVKVSCKASGYTFTHYGINWVRQPPGQGLEWMGWINTYTGEPYYAPGFQERFVFSLDTSQD
TAYLQINSLKAEDTAVYYCARDYYGSSPYWGQGTLVTVSS/GKPGSGKPGSGKPGSGKPGS/DIVMTQSPDSLAVSL
GERVTINCKASQSIVHSNGNTYLEWYQQKPGQPPKLLIYKVSNRFSGVPDRFSGSGSGTDFTLTISSVEAEDAATYY
CFQGSHVPNTFGQGTKVEIK/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VMHEALHNHYTQKSLSLSPGK

Light Chain 3 – 7G8_L1.34 (SEQ ID NOS 43719-43723)
DIVLTQSPSSLSASVGDRVTITCRASQSVDYDGDSYMNWYQQKPGKPPKLLIYAASELESGIPARFSGSGSGTDFTL
TISSLQPEDFATYYCQQSNEDPFTFGSGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC XenCs504: PD-1 X LAG-3
> 2A11_H1.144_L2.142_[LAG-3]_Fab-1C11[PD-1]_H3.234_L3.144_scFv(GKPGS)4-IgG1_pI(-)_Isosteric_A_/PVA_/S267K/L368D/K370S-Fc(216)_IgG1_C220S/PVA_/S267K/S364K/E357Q

Fab Chain 1 – 2A11_H1.144_ IgG1_pI(-)_Isosteric_A_/PVA_/S267K/L368D/K370S (SEQ ID NOS 43724-43728)
EVQLVQSGAEVKKPGATVKISCKASGFNIKDYFMHWVQQAPGKGLEWMGWIDPELGDTEYAPKFQGRVTITADTSTN
TAYMELSSLRSEDTAVYYCYARGVYQALDYWGQGTLVTVSS/ASTKGPSVFPLAPSSKSTSGGTAALGCLVKDYFPE
PVTVSWNSGALTSGVHTFPAVLQSSGLYSLSSVVTVPSSSLGTQTYICNVNHKPSDTKVDKKVEPKSCDKTHTCPPC
PAPPVAGPSVFLFPPKPKDTLMISRTPEVTCVVVDVKHEDPEVKFNWYVDGVEVHNAKTKPREEEYNSTYRVVSVLT
VLHQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

FIG. 49D scFv Chain 2 – 1C11[PD-1]_H3.234_L3.144_scFv(GKPGS)4_Fc(216)_IgG1_C220S/PVA_/S267K/S364K/E357Q (SEQ ID NOS 43729-43738 and linker disclosed as SEQ ID NO: 39202)

EVQLVQSGSELKKPGESVKVSCKASGYTFTHYGINWVRQPPGQGLEWMGWINTYTGEPYYAPGFQERFVFSLDTSQD
TAYLQINSLKAEDTAVYYCARDYYGSSPYWGQGTLVTVSS/GKPGSGKPGSGKPGSGKPGS/DIVMTQSPDSLAVSL
GERVTINCKASQSIVHSNGNTYLEWYQQKPGQPPKLLIYKVSNRFSGVPDRFSGSGSGTDFTLTISSVEAEDAATYY
CFQGSHVPNTFGQGTKVEIK/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VMHEALHNHYTQKSLSLSPGK

Light Chain 3 – 2A11_L2.142 (SEQ ID NOS 43739-43743)

DIQMTQSPAFLSVTPGEKVTITCQASQDIGNYLNWFQQKPGQTVKLLIYFTSYLHSGVPSRFSGSGSGTDYTFTISS
LEAEDAATYFCQQGNTLPYTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

XenCS505: PD-1 X TIM-3

> 3H3_H1_L2.1_Fab-1C11[PD-1]_H3.234_L3.144-scFv(GKPGS)4-IgG1_pI(-)_Isosteric_A_/PVA_/S267K/L368D/K370S-Fc(216)_IgG1_C220S/PVA_/S267K/S364K/E357Q

Fab Chain 1 – 3H3_H1_ IgG1_pI(-)_Isosteric_A_/PVA_/S267K/L368D/K370S (SEQ ID NOS 43744-43748)

QVTLKESGPVLVKPTETLTLTCTVSGFSLNGYGVNWVRQPPGKGLEWLAMIWGDGSTDYNSALKSRLTISKDNSKSQ
VVLTMTNMDPVDTATYYCARSYYTSDEDYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSDTKVDKKVEPKSCDKTHTCPPCP
APPVAGPSVFLFPPKPKDTLMISRTPEVTCVVVDVKHEDPEVKFNWYVDGVEVHNAKTKPREEEYNSTYRVVSVLTV
LHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK scFv Chain 2 – 1C11[PD-1]_H3.234_L3.144_scFv(GKPGS)4_Fc(216)_IgG1_C220S/PVA_/S267K/S364K/E357Q (SEQ ID NOS 43749-43758 and linker disclosed as SEQ ID NO: 39202)

EVQLVQSGSELKKPGESVKVSCKASGYTFTHYGINWVRQPPGQGLEWMGWINTYTGEPYYAPGFQERFVFSLDTSQD
TAYLQINSLKAEDTAVYYCARDYYGSSPYWGQGTLVTVSS/GKPGSGKPGSGKPGSGKPGS/DIVMTQSPDSLAVSL
GERVTINCKASQSIVHSNGNTYLEWYQQKPGQPPKLLIYKVSNRFSGVPDRFSGSGSGTDFTLTISSVEAEDAATYY
CFQGSHVPNTFGQGTKVEIK/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VMHEALHNHYTQKSLSLSPGK

Light Chain 3 – 3H3_L2.1 (SEQ ID NOS 43759-43763)

DIVMTQSPDSLAVSLGERATINCKSSQSLLNSRTRKNYLAWYQQKPGQSPKLLIYWASTRESGVPDRFTGSGSGTDF
TLTISSLQAEDVAVYYCKQSYSLRTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

FIG. 49E

XENCS:506 PD-1 X BTLA

> 9C6_H1.1_L1_[BTLA]_Fab-1C11[PD-1]_H3.234_L3.144_scFv(GKPGS)4-IgG1_pI(-
)_Isosteric_A_/PVA_/S267K/L368D/K370S-Fc(216)_IgG1_C220S/PVA_/S267K/S364K/E357Q

Fab Chain 1 – 9C6_H1.1_ IgG1_pI(-)_Isosteric_A_/PVA_/S267K/L368D/K370S (SEQ ID NOS 43764-43768)
QVQLKESGAEVKKPGASVKVSCKVSGFSLTGYGVNWVRQAPGQGLEWMGMIWIDGSTDYNSKFQGRVTMTKDNSKST
VYMELSSLRSEDTAVYYCARDRPDGRAMDYWGQGTMVTVSS/ASTKGPSVFPLAPSSKSTSGGTAALGCLVKDYFPE
PVTVSWNSGALTSGVHTFPAVLQSSGLYSLSSVVTVPSSSLGTQTYICNVNHKPSDTKVDKKVEPKSCDKTHTCPPC
PAPPVAGPSVFLFPPKPKDTLMISRTPEVTCVVVDVKHEDPEVKFNWYVDGVEVHNAKTKPREEEYNSTYRVVSVLT
VLHQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK scFv Chain 2 – 1C11[PD-1]_H3.234_L3.144_scFv(GKPGS)4_Fc(216)_IgG1_C220S/PVA_/S267K/S364K/E357Q (SEQ
ID NOS 43769-43778 and linker disclosed as SEQ ID NO: 39202)
EVQLVQSGSELKKPGESVKVSCKASGYTFTHYGINWVRQPPGQGLEWMGWINTYTGEPYYAPGFQERFVFSLDTSQD
TAYLQINSLKAEDTAVYYCARDYYGSSPYWGQGTLVTVSS/GKPGSGKPGSGKPGSGKPGS/DIVMTQSPDSLAVSL
GERVTINCKASQSIVHSNGNTYLEWYQQKPGQPPKLLIYKVSNRFSGVPDRFSGSGSGTDFTLTISSVEAEDAATYY
CFQGSHVPNTFGQGTKVEIK/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VMHEALHNHYTQKSLSLSPGK

Light Chain 3 – 9C6_L1 (SEQ ID NOS 43779-43783)
SIVMTQSPDSLAVSLGERATINCKASQSVSNDVAWYQQKPGQSPKLLIYYASNRYTGVPDRFTGSGYGTDFTLTISS
LQAEDVAVYFCQQDYSSPTFGGGTKLEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC XENCS507 PD-1 X ICOS
> [ICOS]_H0L0_Fab-1C11[PD-1]_H3.240_L3.148-scFv(GKPGS)4-IgG1_pI(-
)_Isosteric_A_/PVA_/S267K/L368D/K370S-Fc(216)_IgG1_C220S/PVA_/S267K/S364K/E357Q

Fab Chain 1 – [ICOS]_H0_ IgG1_pI(-)_Isosteric_A_/PVA_/S267K/L368D/K370S (SEQ ID NOS 43784-43788)
QVQLVQSGAEVKKPGASVKVSCKASGYTFTGYYMHWVRQAPGQGLEWMGWINPHSGGTNYAQKFQGRVTMTRDTSIS
TAYMELSRLRSDDTAVYYCARTYYYDSSGYYHDAFDIWGQGTMVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYKCKVSNKALPAPIEKTISK
AKGQPREPQVYTLPPSREEMTKNQVSLTCDVSGFYPSDIAVEWESDGQPENNYKTTPPVLDSDGSFFLYSKLTVDKSRWEQGDVFSCSVMHEA
LHNHYTQKSLSLSPGK

FIG. 49F scFv Chain 2 – 1C11[PD-1]_H3.240_L3.148_scFv(GKPGS)4_Fc(216)_IgG1_C220S/PVA_/S267K/S364K/E357Q (SEQ ID NOS 43789-43798 and linker disclosed as SEQ ID NO: 39202)
QVQLVQSGPELKKPGESVKVSCKASGYTFT<u>HYGIN</u>WVRQPPGQGLEWMG<u>WINTYTGEPYYAPGFQER</u>FVFSIDTSQD
TAYLQINSLKAEDTAVYYCARD<u>YYGSSPY</u>WGQGTLVTVSS/<u>GKPGSGKPGSGKPGSGKPGS</u>/DVLMTQSPDSLAVSL
GERATINCK<u>SSQSIVHSNGNTYLE</u>WYQQKPGQSPKLLIY<u>KVSNRFS</u>GVPDRFSGSGSGTDFTLTISSLQAEDVAVYY
C<u>FQGSHVPNT</u>FGGGTKVEIK/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VMHEALHNHYTQKSLSLSPGK

Light Chain 3 – [ICOS]_L0 (SEQ ID NOS 43799-43803)
DIQMTQSPSSVSASVGDRVTITC<u>RASQGISRLLA</u>WYQQKPGKAPKLLIY<u>VASSLQS</u>GVPSRFSGSGSGTDFTLTISS
LQPEDFATYYC<u>QQANSFPWT</u>FGQGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC XENCS508 PD-1 X ICOS
>[ICOS]_H0.66_L0_Fab-1C11[PD-1]_H3.240_L3.148-scFv(GKPGS)4-IgG1_pI(-)_Isosteric_A_/PVA_/S267K/L368D/K370S-Fc(216)_IgG1_C220S/PVA_/S267K/S364K/E357Q

Fab Chain 1 – [ICOS]_H0.66_IgG1_pI(-)_Isosteric_A_/PVA_/S267K/L368D/K370S (SEQ ID NOS 43804-43808)
QVQLVQSGAEVKKPGASVKVSCKASGYTFT<u>GYYMH</u>WVRQAPGQGLEWMG<u>WINPHSGETIYAQKFQG</u>RVTMTRDTSIS
TAYMELSSLRSEDTAVYYCART<u>YYYDTSGYYHDAFDV</u>WGQGTMVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSCDK
THTCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPSDI
AVEWESDGQPENNYKTTPPVLDSDGSFFLYSKLTVDKSRWEQGDVFSCSVMHEALHNHYTQKSLSLSPGK scFv Chain 2 – 1C11[PD-1]_H3.240_L3.148_scFv(GKPGS)4_Fc(216)_IgG1_C220S/PVA_/S267K/S364K/E357Q (SEQ ID NOS 43809-43818 and linker disclosed as SEQ ID NO: 39202)
QVQLVQSGPELKKPGESVKVSCKASGYTFT<u>HYGIN</u>WVRQPPGQGLEWMG<u>WINTYTGEPYYAPGFQER</u>FVFSIDTSQD
TAYLQINSLKAEDTAVYYCARD<u>YYGSSPY</u>WGQGTLVTVSS/<u>GKPGSGKPGSGKPGSGKPGS</u>/DVLMTQSPDSLAVSL
GERATINCK<u>SSQSIVHSNGNTYLE</u>WYQQKPGQSPKLLIY<u>KVSNRFS</u>GVPDRFSGSGSGTDFTLTISSLQAEDVAVYY
C<u>FQGSHVPNT</u>FGGGTKVEIK/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VMHEALHNHYTQKSLSLSPGK

Light Chain 3 – [ICOS]_L0 (SEQ ID NOS 43819-43823)
DIQMTQSPSSVSASVGDRVTITC<u>RASQGISRLLA</u>WYQQKPGKAPKLLIY<u>VASSLQS</u>GVPSRFSGSGSGTDFTLTISS
LQPEDFATYYC<u>QQANSFPWT</u>FGQGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

FIG. 49G

```
XENCS509 PD-1 X CTLA-4
>[CTLA-4]_H3_L0.22_Fab-1C11[PD-1]_H3.240_L3.148_scFv(GKPGS)4-IgG1_pI(-
)_Isosteric_A_/PVA_/S267K/L368D/K370S-Fc(216)_IgG1_C220S/PVA_/S267K/S364K/E357Q
```

Fab Chain 1 - [CTLA-4]_H3_ IgG1_pI(-)_Isosteric_A_/PVA_/S267K/L368D/K370S (SEQ ID NOS 43824-43828)
EVQLVESGGGLVKPGGSLRLSCAASGFTFSSYTMHWVRQAPGKGLEWVSFISYDGNNKYYADSVKGRFTISRDNAKN
SLYLQMNSLRAEDTAVYYCARTGWLGPFDYWGQGTLVTVSS/ASTKGPSVFPLAPSSKSTSGGTAALGCLVKDYFPE
PVTVSWNSGALTSGVHTFPAVLQSSGLYSLSSVVTVPSSSLGTQTYICNVNHKPSDTKVDKKVEPKSCDKTHTCPPC
PAPPVAGPSVFLFPPKPKDTLMISRTPEVTCVVVDVKHEDPEVKFNWYVDGVEVHNAKTKPREEEYNSTYRVVSVLT
VLHQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK scFv Chain 2 - 1C11[PD-1]_H3.240_L3.148_scFv(GKPGS)4_Fc(216)_IgG1_C220S/PVA_/S267K/S364K/E357Q (SEQ ID NOS 43829-43838 and linker disclosed as SEQ ID NO: 39202)
QVQLVQSGPELKKPGESVKVSCKASGYTFTHYGINWVRQPPGQGLEWMGWINTYTGEPYYAPGFQERFVFSIDTSQD
TAYLQINSLKAEDTAVYYCARDYYGSSPYWGQGTLVTVSS/GKPGSGKPGSGKPGSGKPGS/DVLMTQSPDSLAVSL
GERATINCKSSQSIVHSNGNTYLEWYQQKPGQSPKLLIYKVSNRFSGVPDRFSGSGSGTDFTLTISSLQAEDVAVYY
CFQGSHVPNTFGGGTKVEIK/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VMHEALHNHYTQKSLSLSPGK

Light Chain 3 - [CTLA-4]_L0.22 (SEQ ID NOS 43839-43843)
EIVLTQSPGTLSLSPGERATLSCRASQSVSSSYLAWYQQKPGQAPRLLIYGAFSRATGIPDRFSGSGSGTDFTLTIS
RLEPEDFAVYYCQQYGSSPWTFGQGTKVEIK/RTVAAPSVFIFPPSDEQLKSGTASVVCLLNNFYPREAKVQWKVDN
ALQSGNSQESVTEQDSKDSTYSLSSTLTLSKADYEKHKVYACEVTHQGLSSPVTKSFNRGEC

```
XENCs510PD-1 X LAG-3
>7G8_H3.30_L1.34_[LAG-3]_Fab-1C11[PD-1]_H3.240_L3.148_scFv(GKPGS)4-IgG1_pI(-
)_Isosteric_A_/PVA_/S267K/L368D/K370S-Fc(216)_IgG1_C220S/PVA_/S267K/S364K/E357Q
```

Fab Chain 1 – 7G8_H3.30_ IgG1_pI(-)_Isosteric_A_/PVA_/S267K/L368D/K370S (SEQ ID NOS 43844-43848)
EVQLVESGGGLVQPGGSLRLSCAASGFTFDDAWMSWVRQAPGKGLEWVAEISTKANNHATYYAESVKGRFTISRDDS
KSSVYLQMNSLRAEDTAVYYCTRLATWDWYFDVWGQGTTVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK

FIG. 49H scFv Chain 2 – 1C11[PD-1]_H3.240_L3.148_scFv(GKPGS)4_Fc(216)_IgG1_C220S/PVA_/S267K/S364K/E357Q (SEQ ID NOS 43849-43858 and linker disclosed as SEQ ID NO: 39202)
QVQLVQSGPELKKPGESVKVSCKASGYTFTHYGINWVRQPPGQGLEWMGWINTYTGEPYYAPGFQERFVFSIDTSQD
TAYLQINSLKAEDTAVYYCARDYYGSSPYWGQGTLVTVSS/GKPGSGKPGSGKPGSGKPGS/DVLMTQSPDSLAVSL
GERATINCKSSQSIVHSNGNTYLEWYQQKPGQSPKLLIYKVSNRFSGVPDRFSGSGSGTDFTLTISSLQAEDVAVYY
CFQGSHVPNTFGGGTKVEIK/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VMHEALHNHYTQKSLSLSPGK

Light Chain 3 – 7G8_L1.34 (SEQ ID NOS 43859-43863)
DIVLTQSPSSLSASVGDRVTITCRASQSVDYDGDSYMNWYQQKPGKPPKLLIYAASELESGIPARFSGSGSGTDFTL
TISSLQPEDFATYYCQQSNEDPFTFGSGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC XENCS511 PD-1 X LAG-3
> 2A11_H1.144_L2.142_[LAG-3]_Fab-1C11[PD-1]_H3.240_L3.148_scFv(GKPGS)4-IgG1_pI(-)_Isosteric_A_/PVA_/S267K/L368D/K370S-Fc(216)_IgG1_C220S/PVA_/S267K/S364K/E357Q

Fab Chain 1 – 2A11_H1.144_IgG1_pI(-)_Isosteric_A_/PVA_/S267K/L368D/K370S (SEQ ID NOS 43864-43868)
EVQLVQSGAEVKKPGATVKISCKASGFNIKDYFMHWVQQAPGKGLEWMGWIDPELGDTEYAPKFQGRVTITADTSTN
TAYMELSSLRSEDTAVYYCYARGVYQALDYWGQGTLVTVSS/ASTKGPSVFPLAPSSKSTSGGTAALGCLVKDYFPE
PVTVSWNSGALTSGVHTFPAVLQSSGLYSLSSVVTVPSSSLGTQTYICNVNHKPSDTKVDKKVEPKSCDKTHTCPPC
PAPPVAGPSVFLFPPKPKDTLMISRTPEVTCVVVDVKHEDPEVKFNWYVDGVEVHNAKTKPREEEYNSTYRVVSVLT
VLHQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK scFv Chain 2 – 1C11[PD-1]_H3.240_L3.148_scFv(GKPGS)4_Fc(216)_IgG1_C220S/PVA_/S267K/S364K/E357Q (SEQ ID NOS 43869-43878 and linker disclosed as SEQ ID NO: 39202)
QVQLVQSGPELKKPGESVKVSCKASGYTFTHYGINWVRQPPGQGLEWMGWINTYTGEPYYAPGFQERFVFSIDTSQD
TAYLQINSLKAEDTAVYYCARDYYGSSPYWGQGTLVTVSS/GKPGSGKPGSGKPGSGKPGS/DVLMTQSPDSLAVSL
GERATINCKSSQSIVHSNGNTYLEWYQQKPGQSPKLLIYKVSNRFSGVPDRFSGSGSGTDFTLTISSLQAEDVAVYY
CFQGSHVPNTFGGGTKVEIK/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VMHEALHNHYTQKSLSLSPGK

Light Chain 3 – 2A11_L2.142 (SEQ ID NOS 43879-43883)
DIQMTQSPAFLSVTPGEKVTITCQASQDIGNYLNWFQQKPGQTVKLLIYFTSYLHSGVPSRFSGSGSGTDYTFTISS
LEAEDAATYFCQQGNTLPYTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

FIG. 49I

```
XENCS512 PD-1 X TIM-3
> 3H3_H1_L2.1_Fab-1C11[PD-1]_H3.240_L3.148-scFv(GKPGS)4-IgG1_pI(-
)_Isosteric_A_/PVA_/S267K/L368D/K370S-Fc(216)_IgG1_C220S/PVA_/S267K/S364K/E357Q
```

Chain 1 – 3H3_H1_ IgG1_pI(-)_Isosteric_A_/PVA_/S267K/L368D/K370S (SEQ ID NOS 43884-43888)
QVTLKESGPVLVKPTETLTLTCTVSGFSLNGYGVNWVRQPPGKGLEWLAMIWGDGSTDYNSALKSRLTISKDNSKSQ
VVLTMTNMDPVDTATYYCARSYYTSDEDYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSDTKVDKKVEPKSCDKTHTCPPCP
APPVAGPSVFLFPPKPKDTLMISRTPEVTCVVVDVKHEDPEVKFNWYVDGVEVHNAKTKPREEEYNSTYRVVSVLTV
LHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK

Chain 2 – 1C11[PD-1]_H3.240_L3.148_scFv(GKPGS)4_Fc(216)_IgG1_C220S/PVA_/S267K/S364K/E357Q (SEQ ID NOS 43889-43898 and linker disclosed as SEQ ID NO: 39202)
QVQLVQSGPELKKPGESVKVSCKASGYTFTHYGINWVRQPPGQGLEWMGWINTYTGEPYYAPGFQERFVFSIDTSQD
TAYLQINSLKAEDTAVYYCARDYYGSSPYWGQGTLVTVSS/GKPGSGKPGSGKPGSGKPGS/DVLMTQSPDSLAVSL
GERATINCKSSQSIVHSNGNTYLEWYQQKPGQSPKLLIYKVSNRFSGVPDRFSGSGSGTDFTLTISSLQAEDVAVYY
CFQGSHVPNTFGGGTKVEIK/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VMHEALHNHYTQKSLSLSPGK

Chain 3 – 3H3_L2.1 (SEQ ID NOS 43899-43903)
DIVMTQSPDSLAVSLGERATINCKSSQSLLNSRTRKNYLAWYQQKPGQSPKLLIYWASTRESGVPDRFTGSGSGTDF
TLTISSLQAEDVAVYYCKQSYSLRTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

```
XENCS513 PD-1 X BTLA
> 9C6_H1.1_L1_[BTLA]_Fab-1C11[PD-1]_H3.240_L3.148_scFv(GKPGS)4-IgG1_pI(-
)_Isosteric_A_/PVA_/S267K/L368D/K370S-Fc(216)_IgG1_C220S/PVA_/S267K/S364K/E357Q
```

Chain 1 – 9C6_H1.1_ IgG1_pI(-)_Isosteric_A_/PVA_/S267K/L368D/K370S (SEQ ID NOS 43904-43908)
QVQLKESGAEVKKPGASVKVSCKVSGFSLTGYGVNWVRQAPGQGLEWMGMIWIDGSTDYNSKFQGRVTMTKDNSKST
VYMELSSLRSEDTAVYYCARDRPDGRAMDYWGQGTMVTVSS/ASTKGPSVFPLAPSSKSTSGGTAALGCLVKDYFPE
PVTVSWNSGALTSGVHTFPAVLQSSGLYSLSSVVTVPSSSLGTQTYICNVNHKPSDTKVDKKVEPKSCDKTHTCPPC
PAPPVAGPSVFLFPPKPKDTLMISRTPEVTCVVVDVKHEDPEVKFNWYVDGVEVHNAKTKPREEEYNSTYRVVSVLT
VLHQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

FIG. 49J

Chain 2 – 1C11[PD-1]_H3.240_L3.148_scFv(GKPGS)4_Fc(216)_IgG1_C220S/PVA_/S267K/S364K/E357Q (SEQ ID NOS 43909-43918 and linker disclosed as SEQ ID NO: 39202)
QVQLVQSGPELKKPGESVKVSCKASGYTFTHYGINWVRQPPGQGLEWMGWINTYTGEPYYAPGFQERFVFSIDTSQD
TAYLQINSLKAEDTAVYYCARDYYGSSPYWGQGTLVTVSS/GKPGSGKPGSGKPGSGKPGS/DVLMTQSPDSLAVSL
GERATINCKSSQSIVHSNGNTYLEWYQQKPGQSPKLLIYKVSNRFSGVPDRFSGSGSGTDFTLTISSLQAEDVAVYY
CFQGSHVPNTFGGGTKVEIK/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VMHEALHNHYTQKSLSLSPGK

Chain 3 – 9C6_L1 (SEQ ID NOS 43919-43923)
SIVMTQSPDSLAVSLGERATINCKASQSVSNDVAWYQQKPGQSPKLLIYYASNRYTGVPDRFTGSGYGTDFTLTISS
LQAEDVAVYFCQQDYSSPTFGGGTKLEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC XENCS514 PD_1 X ICOS
> [ICOS]_H0L0_Fab-1C11[PD-1]_H3.241_L3.148-scFv(GKPGS)4-IgG1_pI(-
)_Isosteric_A_/PVA_/S267K/L368D/K370S-Fc(216)_IgG1_C220S/PVA_/S267K/S364K/E357Q

Chain 1 – [ICOS]_H0_IgG1_pI(-)_Isosteric_A_/PVA_/S267K/L368D/K370S (SEQ ID NOS 43924-43928)
QVQLVQSGAEVKKPGASVKVSCKASGYTFTGYYMHWVRQAPGQGLEWMGWINPHSGGTNYAQKFQGRVTMTRDTSIS
TAYMELSRLRSDDTAVYYCARTYYYDSSGYYHDAFDIWGQGTMVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYKCKVSNKALPAPIEKTISK
AKGQPREPQVYTLPPSREEMTKNQVSLTCDVSGFYPSDIAVEWESDGQPENNYKTTPPVLDSDGSFFLYSKLTVDKSRWEQGDVFSCSVMHEA
LHNHYTQKSLSLSPGK

Chain 2 – 1C11[PD-1]_H3.241_L3.148_scFv(GKPGS)4_Fc(216)_IgG1_C220S/PVA_/S267K/S364K/E357Q (SEQ ID NOS 43929-43938 and linker disclosed as SEQ ID NO: 39202)
EVQLVQSGPELKKPGESVKVSCKASGYTFTHYGINWVRQPPGQGLEWMGWINTYTGEPYYAPGFQERFVFSIDTSQD
TAYLQINSLKAEDTAVYYCARDYYGSSPYWGQGTLVTVSS/GKPGSGKPGSGKPGSGKPGS/DVLMTQSPDSLAVSL
GERATINCKSSQSIVHSNGNTYLEWYQQKPGQSPKLLIYKVSNRFSGVPDRFSGSGSGTDFTLTISSLQAEDVAVYY
CFQGSHVPNTFGGGTKVEIK/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VMHEALHNHYTQKSLSLSPGK

Chain 3 – [ICOS]_L0 (SEQ ID NOS 43939-43943)
DIQMTQSPSSVSASVGDRVTITCRASQGISRLLAWYQQKPGKAPKLLIYVASSLQSGVPSRFSGSGSGTDFTLTISS
LQPEDFATYYCQQANSFPWTFGQGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

FIG. 49K

```
XENCS515 PD_1 X ICOS
```
> [ICOS]_H0.66_L0_Fab-1C11[PD-1]_H3.241_L3.148-scFv(GKPGS)4-IgG1_pI(-)_Isosteric_A_/PVA_/S267K/L368D/K370S-Fc(216)_IgG1_C220S/PVA_/S267K/S364K/E357Q

Chain 1 – [ICOS]_H0.66_ IgG1_pI(-)_Isosteric_A_/PVA_/S267K/L368D/K370S (SEQ ID NOS 43944-43948)
QVQLVQSGAEVKKPGASVKVSCKASGYTFT<u>GYYMH</u>WVRQAPGQGLEWMG<u>WINPHSGETIYAQKFQG</u>RVTMTRDTSISTAYME
LSSLRSEDTAVYYCAR<u>TYYYDTSGYYHDAFDV</u>WGQGTMVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSDTKVDKKVEPKSCDKTHTCPPCPAPPVAGP
SVFLFPPKPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTPPVLDSDG
SFFLYSKLTVDKSRWEQGDVFSCSVMHEALHNHYTQKSLSLSPGK

Chain 2 – 1C11[PD-1]_H3.241_L3.148_scFv(GKPGS)4_Fc(216)_IgG1_C220S/PVA_/S267K/S364K/E357Q (SEQ ID NOS 43949-43958 and linker disclosed as SEQ ID NO: 39202)
EVQLVQSGPELKKPGESVKVSCKASGYTFT<u>HYGIN</u>WVRQPPGQGLEWMG<u>WINTYTGEPYYAPGFQER</u>FVFSIDTSQDTAYLQ
INSLKAEDTAVYYCAR<u>DYYGSSPYW</u>GQGTLVTVSS/<u>GKPGSGKPGSGKPGSGKPGS</u>/DVLMTQSPDSLAVSLGERATINCK<u>S
SQSIVHSNGNTYLE</u>WYQQKPGQSPKLLIY<u>KVSNRFS</u>GVPDRFSGSGSGTDFTLTISSLQAEDVAVYYC<u>FQGSHVPNTF</u>GGGT
KVEIK/EPKSSDKTHTCPPCPAPPVAGPSVFLFPPKPKDTLMISRTPEVTCVVVDVKHEDPEVKFNWYVDGVEVHNAKTKPR
EEQYNSTYRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK

Chain 3 – [ICOS]_L0 (SEQ ID NOS 43959-43963)
DIQMTQSPSSVSASVGDRVTITCR<u>ASQGISRLLA</u>WYQQKPGKAPKLLIY<u>VASSLQS</u>GVPSRFSGSGSGTDFTLTISSLQPED
FATYYC<u>QQANSFPWT</u>FGQGTKVEIK/RTVAAPSVFIFPPSDEQLKSGTASVVCLLNNFYPREAKVQWKVDNALQSGNSQESV
TEQDSKDSTYSLSSTLTLSKADYEKHKVYACEVTHQGLSSPVTKSFNRGEC

```
XENCS516 PD-1 X CTLA-4
```
> [CTLA-4]_H3_L0.22_Fab-1C11[PD-1]_H3.241_L3.148_scFv(GKPGS)4-IgG1_pI(-)_Isosteric_A_/PVA_/S267K/L368D/K370S-Fc(216)_IgG1_C220S/PVA_/S267K/S364K/E357Q

Chain 1 - [CTLA-4]_H3_ IgG1_pI(-)_Isosteric_A_/PVA_/S267K/L368D/K370S (SEQ ID NOS 43964-43968)
EVQLVESGGGLVKPGGSLRLSCAASGFTFS<u>SYTMH</u>WVRQAPGKGLEWVS<u>FISYDGNNKYYADSVKG</u>RFTISRDNAKNSLYLQ
MNSLRAEDTAVYYCAR<u>TGWLGPFDY</u>WGQGTLVTVSS/ASTKGPSVFPLAPSSKSTSGGTAALGCLVKDYFPEPVTVSWNSGA
LTSGVHTFPAVLQSSGLYSLSSVVTVPSSSLGTQTYICNVNHKPSDTKVDKKVEPKSCDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYKCKVSNKA
LPAPIEKTISKAKGQPREPQVYTLPPSREEMTKNQVSLTCDVSGFYPSDIAVEWESDGQPENNYKTTPPVLDSDGSFFLYSK
LTVDKSRWEQGDVFSCSVMHEALHNHYTQKSLSLSPGK

Chain 2 - 1C11[PD-1]_H3.241_L3.148_scFv(GKPGS)4_Fc(216)_IgG1_C220S/PVA_/S267K/S364K/E357Q (SEQ ID NOS 43969-43978 and linker disclosed as SEQ ID NO: 39202)
EVQLVQSGPELKKPGESVKVSCKASGYTFT<u>HYGIN</u>WVRQPPGQGLEWMG<u>WINTYTGEPYYAPGFQER</u>FVFSIDTSQDTAYLQ
INSLKAEDTAVYYCAR<u>DYYGSSPYW</u>GQGTLVTVSS/<u>GKPGSGKPGSGKPGSGKPGS</u>/DVLMTQSPDSLAVSLGERATINCK<u>S
SQSIVHSNGNTYLE</u>WYQQKPGQSPKLLIY<u>KVSNRFS</u>GVPDRFSGSGSGTDFTLTISSLQAEDVAVYYC<u>FQGSHVPNTF</u>GGGT
KVEIK/EPKSSDKTHTCPPCPAPPVAGPSVFLFPPKPKDTLMISRTPEVTCVVVDVKHEDPEVKFNWYVDGVEVHNAKTKPR
EEQYNSTYRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK

FIG. 49L

Chain 3 - [CTLA-4]_L0.22 (SEQ ID NOS 43979-43983)
EIVLTQSPGTLSLSPGERATLSCRASQSVSSSYLAWYQQKPGQAPRLLIYGAFSRATGIPDRFSGSGSGTDFTLTIS
RLEPEDFAVYYCQQYGSSPWTFGQGTKVEIK/RTVAAPSVFIFPPSDEQLKSGTASVVCLLNNFYPREAKVQWKVDN
ALQSGNSQESVTEQDSKDSTYSLSSTLTLSKADYEKHKVYACEVTHQGLSSPVTKSFNRGEC XENCS517 PD_1 X LAG-3
> 7G8_H3.30_L1.34_[LAG-3]_Fab-1C11[PD-1]_H3.241_L3.148_scFv(GKPGS)4-IgG1_pI(-
)_Isosteric_A_/PVA_/S267K/L368D/K370S-Fc(216)_IgG1_C220S/PVA_/S267K/S364K/E357Q

Chain 1 – 7G8_H3.30_ IgG1_pI(-)_Isosteric_A_/PVA_/S267K/L368D/K370S (SEQ ID NOS 43984-43988)
EVQLVESGGGLVQPGGSLRLSCAASGFTFDDAWMSWVRQAPGKGLEWVAEISTKANNHATYYAESVKGRFTISRDDS
KSSVYLQMNSLRAEDTAVYYCTRLATWDWYFDVWGQGTTVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVMHEALHNHYTQKSLSLSPGK

Chain 2 –1C11[PD-1]_H3.241_L3.148_scFv(GKPGS)4_Fc(216)_IgG1_C220S/PVA_/S267K/S364K/E357Q (SEQ ID NOS 43989-43998 and linker disclosed as SEQ ID NO: 39202)
EVQLVQSGPELKKPGESVKVSCKASGYTFTHYGINWVRQPPGQGLEWMGWINTYTGEPYYAPGFQERFVFSIDTSQD
TAYLQINSLKAEDTAVYYCARDYYGSSPYWGQGTLVTVSS/GKPGSGKPGSGKPGSGKPGS/DVLMTQSPDSLAVSL
GERATINCKSSQSIVHSNGNTYLEWYQQKPGQSPKLLIYKVSNRFSGVPDRFSGSGSGTDFTLTISSLQAEDVAVYY
CFQGSHVPNTFGGGTKVEIK/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VMHEALHNHYTQKSLSLSPGK

Chain 3 – 7G8_L1.34 (SEQ ID NOS 43999-44003)
DIVLTQSPSSLSASVGDRVTITCRASQSVDYDGDSYMNWYQQKPGKPPKLLIYAASELESGIPARFSGSGSGTDFTL
TISSLQPEDFATYYCQQSNEDPFTFGSGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC XENCS518 PD_1 X LAG-3
> 2A11_H1.144_L2.142_[LAG-3]_Fab-1C11[PD-1]_H3.241_L3.148_scFv(GKPGS)4-IgG1_pI(-
)_Isosteric_A_/PVA_/S267K/L368D/K370S-Fc(216)_IgG1_C220S/PVA_/S267K/S364K/E357Q

Chain 1 – 2A11_H1.144_ IgG1_pI(-)_Isosteric_A_/PVA_/S267K/L368D/K370S (SEQ ID NOS 44004-44008)
EVQLVQSGAEVKKPGATVKISCKASGFNIKDYFMHWVQQAPGKGLEWMGWIDPELGDTEYAPKFQGRVTITADTSTN
TAYMELSSLRSEDTAVYYCYARGVYQALDYWGQGTLVTVSS/ASTKGPSVFPLAPSSKSTSGGTAALGCLVKDYFPE
PVTVSWNSGALTSGVHTFPAVLQSSGLYSLSSVVTVPSSSLGTQTYICNVNHKPSDTKVDKKVEPKSCDKTHTCPPC
PAPPVAGPSVFLFPPKPKDTLMISRTPEVTCVVVDVKHEDPEVKFNWYVDGVEVHNAKTKPREEEYNSTYRVVSVLT
VLHQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

FIG. 49M

Chain 2 – 1C11[PD-1]_H3.241_L3.148_scFv(GKPGS)4_Fc(216)_IgG1_C220S/PVA_/S267K/S364K/E357Q (SEQ ID NOS 44009-44018 and linker disclosed as SEQ ID NO: 39202)
EVQLVQSGPELKKPGESVKVSCKASGYTFTHYGINWVRQPPGQGLEWMGWINTYTGEPYYAPGFQERFVFSIDTSQD
TAYLQINSLKAEDTAVYYCARDYYGSSPYWGQGTLVTVSS/GKPGSGKPGSGKPGSGKPGS/DVLMTQSPDSLAVSL
GERATINCKSSQSIVHSNGNTYLEWYQQKPGQSPKLLIYKVSNRFSGVPDRFSGSGSGTDFTLTISSLQAEDVAVYY
CFQGSHVPNTFGGGTKVEIK/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VMHEALHNHYTQKSLSLSPGK

Chain 3 – 2A11_L2.142 (SEQ ID NOS 44019-44023)
DIQMTQSPAFLSVTPGEKVTITCQASQDIGNYLNWFQQKPGQTVKLLIYFTSYLHSGVPSRFSGSGSGTDYTFTISS
LEAEDAATYFCQQGNTLPYTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC XENCS519 PD-1 X TIM-3
**> 3H3_H1_L2.1_Fab-1C11[PD-1]_H3.241_L3.148-scFv(GKPGS)4-IgG1_pI(-
)_Isosteric_A_/PVA_/S267K/L368D/K370S-Fc(216)_IgG1_C220S/PVA_/S267K/S364K/E357Q**

Chain 1 – 3H3_H1_ IgG1_pI(-)_Isosteric_A_/PVA_/S267K/L368D/K370S (SEQ ID NOS 44024-44028)
QVTLKESGPVLVKPTETLTLTCTVSGFSLNGYGVNWVRQPPGKGLEWLAMIWGDGSTDYNSALKSRLTISKDNSKSQ
VVLTMTNMDPVDTATYYCARSYYTSDEDYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSDTKVDKKVEPKSCDKTHTCPPCP
APPVAGPSVFLFPPKPKDTLMISRTPEVTCVVVDVKHEDPEVKFNWYVDGVEVHNAKTKPREEEYNSTYRVVSVLTV
LHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK

Chain 2 – 1C11[PD-1]_H3.241_L3.148_scFv(GKPGS)4_Fc(216)_IgG1_C220S/PVA_/S267K/S364K/E357Q (SEQ ID NOS 44029-44038 and linker disclosed as SEQ ID NO: 39202)
EVQLVQSGPELKKPGESVKVSCKASGYTFTHYGINWVRQPPGQGLEWMGWINTYTGEPYYAPGFQERFVFSIDTSQD
TAYLQINSLKAEDTAVYYCARDYYGSSPYWGQGTLVTVSS/GKPGSGKPGSGKPGSGKPGS/DVLMTQSPDSLAVSL
GERATINCKSSQSIVHSNGNTYLEWYQQKPGQSPKLLIYKVSNRFSGVPDRFSGSGSGTDFTLTISSLQAEDVAVYY
CFQGSHVPNTFGGGTKVEIK/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VMHEALHNHYTQKSLSLSPGK

Chain 3 – 3H3_L2.1 (SEQ ID NOS 44039-44043)
DIVMTQSPDSLAVSLGERATINCKSSQSLLNSRTRKNYLAWYQQKPGQSPKLLIYWASTRESGVPDRFTGSGSGTDF
TLTISSLQAEDVAVYYCKQSYSLRTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

FIG. 49N

XENCS520 PD-1 X BTLA
> 9C6_H1.1_L1_[BTLA]_Fab-1C11[PD-1]_H3.241_L3.148_scFv(GKPGS)4-IgG1_pI(-)_Isosteric_A_/PVA_/S267K/L368D/K370S-Fc(216)_IgG1_C220S/PVA_/S267K/S364K/E357Q

Chain 1 – 9C6_H1.1_ IgG1_pI(-)_Isosteric_A_/PVA_/S267K/L368D/K370S (SEQ ID NOS 44044-44048)
QVQLKESGAEVKKPGASVKVSCKVSGFSLTGYGVNWVRQAPGQGLEWMGMIWIDGSTDYNSKFQGRVTMTKDNSKST
VYMELSSLRSEDTAVYYCARDRPDGRAMDYWGQGTMVTVSS/ASTKGPSVFPLAPSSKSTSGGTAALGCLVKDYFPE
PVTVSWNSGALTSGVHTFPAVLQSSGLYSLSSVVTVPSSSLGTQTYICNVNHKPSDTKVDKKVEPKSCDKTHTCPPC
PAPPPVAGPSVFLFPPKPKDTLMISRTPEVTCVVVDVKHEDPEVKFNWYVDGVEVHNAKTKPREEEYNSTYRVVSVLT
VLHQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 – 1C11[PD-1]_H3.241_L3.148_scFv(GKPGS)4_Fc(216)_IgG1_C220S/PVA_/S267K/S364K/E357Q (SEQ ID
NOS 44049-44058 and linker disclosed as SEQ ID NO: 39202)
EVQLVQSGPELKKPGESVKVSCKASGYTFTHYGINWVRQPPGQGLEWMGWINTYTGEPYYAPGFQERFVFSIDTSQD
TAYLQINSLKAEDTAVYYCARDYYGSSPYWGQGTLVTVSS/GKPGSGKPGSGKPGSGKPGS/DVLMTQSPDSLAVSL
GERATINCKSSQSIVHSNGNTYLEWYQQKPGQSPKLLIYKVSNRFSGVPDRFSGSGSGTDFTLTISSLQAEDVAVYY
CFQGSHVPNTFGGGTKVEIK/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VMHEALHNHYTQKSLSLSPGK

Chain 3 – 9C6_L1 (SEQ ID NOS 44059-44063)
SIVMTQSPDSLAVSLGERATINCKASQSVSNDVAWYQQKPGQSPKLLIYYASNRYTGVPDRFTGSGYGTDFTLTISS
LQAEDVAVYFCQQDYSSPTFGGGTKLEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC XENCS521 PD-1 X ICOS
> [ICOS]_H0L0_Fab-1C11[PD-1]_H3.241_L3.92-scFv(GKPGS)4-IgG1_pI(-)_Isosteric_A_/PVA_/S267K/L368D/K370S-Fc(216)_IgG1_C220S/PVA_/S267K/S364K/E357Q

Chain 1 – [ICOS]_H0_ IgG1_pI(-)_Isosteric_A_/PVA_/S267K/L368D/K370S (SEQ ID NOS 44064-44068)
QVQLVQSGAEVKKPGASVKVSCKASGYTFTGYYMHWVRQAPGQGLEWMGWINPHSGGTNYAQKFQGRVTMTRDTSIS
TAYMELSRLRSDDTAVYYCARTYYYDSSGYYHDAFDIWGQGTMVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYKCKVSNKALPAPIEKTISK
AKGQPREPQVYTLPPSREEMTKNQVSLTCDVSGFYPSDIAVEWESDGQPENNYKTTPPVLDSDGSFFLYSKLTVDKSRWEQGDVFSCSVMHEA
LHNHYTQKSLSLSPGK

FIG. 49O

Chain 2 – 1C11[PD-1]_H3.241_L3.92_scFv(GKPGS)4_Fc(216)_IgG1_C220S/PVA_/S267K/S364K/E357Q (SEQ ID NOS 44069-44078 and linker disclosed as SEQ ID NO: 39202)
EVQLVQSGPELKKPGESVKVSCKASGYTFTHYGINWVRQPPGQGLEWMGWINTYTGEPYYAPGFQERFVFSIDTSQD
TAYLQINSLKAEDTAVYYCARDYYGSSPYWGQGTLVTVSS/GKPGSGKPGSGKPGSGKPGS/DIVMTQSPDSLAVSL
GERVTINCKASQSIVHSNGNTYLEWYQQKPGQPPKLLIYKVSNRFTGVPDRFSGSGSGTDFTLTISSLQAEDVAVYY
CFQGSHVPNTFGGGTKVEIK/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VMHEALHNHYTQKSLSLSPGK

Chain 3 – [ICOS]_L0 (SEQ ID NOS 44079-44083)
DIQMTQSPSSVSASVGDRVTITCRASQGISRLLAWYQQKPGKAPKLLIYVASSLQSGVPSRFSGSGSGTDFTLTISS
LQPEDFATYYCQQANSFPWTFGQGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

```
XENCS522 PD-1 X ICOS
```
> [ICOS]_H0.66_L0_Fab-1C11[PD-1]_H3.241_L3.92-scFv(GKPGS)4-IgG1_pI(-
)_Isosteric_A_/PVA_/S267K/L368D/K370S-Fc(216)_IgG1_C220S/PVA_/S267K/S364K/E357Q

Chain 1 – [ICOS]_H0.66_IgG1_pI(-)_Isosteric_A_/PVA_/S267K/L368D/K370S (SEQ ID NOS 44084-44088)
QVQLVQSGAEVKKPGASVKVSCKASGYTFTGYYMHWVRQAPGQGLEWMGWINPHSGETIYAQKFQGRVTMTRDTSIS
TAYMELSSLRSEDTAVYYCARTYYYDTSGYYHDAFDVWGQGTMVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSCDK
THTCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPSDI
AVEWESDGQPENNYKTTPPVLDSDGSFFLYSKLTVDKSRWEQGDVFSCSVMHEALHNHYTQKSLSLSPGK

Chain 2 – 1C11[PD-1]_H3.241_L3.92_scFv(GKPGS)4_Fc(216)_IgG1_C220S/PVA_/S267K/S364K/E357Q (SEQ ID NOS 44089-44098 and linker disclosed as SEQ ID NO: 39202)
EVQLVQSGPELKKPGESVKVSCKASGYTFTHYGINWVRQPPGQGLEWMGWINTYTGEPYYAPGFQERFVFSIDTSQD
TAYLQINSLKAEDTAVYYCARDYYGSSPYWGQGTLVTVSS/GKPGSGKPGSGKPGSGKPGS/DIVMTQSPDSLAVSL
GERVTINCKASQSIVHSNGNTYLEWYQQKPGQPPKLLIYKVSNRFTGVPDRFSGSGSGTDFTLTISSLQAEDVAVYY
CFQGSHVPNTFGGGTKVEIK/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VMHEALHNHYTQKSLSLSPGK

Chain 3 – [ICOS]_L0 (SEQ ID NOS 44099-44103)
DIQMTQSPSSVSASVGDRVTITCRASQGISRLLAWYQQKPGKAPKLLIYVASSLQSGVPSRFSGSGSGTDFTLTISS
LQPEDFATYYCQQANSFPWTFGQGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

FIG. 49P

XENCS523 PD-1 X CTLA-4
> [CTLA-4]_H3_L0.22_Fab-1C11[PD-1]_H3.241_L3.92_scFv(GKPGS)4-IgG1_pI(-
)_Isosteric_A_/PVA_/S267K/L368D/K370S-Fc(216)_IgG1_C220S/PVA_/S267K/S364K/E357Q

Chain 1 - [CTLA-4]_H3_ IgG1_pI(-)_Isosteric_A_/PVA_/S267K/L368D/K370S (SEQ ID NOS 44104-44108)
EVQLVESGGGLVKPGGSLRLSCAASGFTFSSYTMHWVRQAPGKGLEWVSFISYDGNNKYYADSVKGRFTISRDNAKNSLYLQ
MNSLRAEDTAVYYCARTGWLGPFDYWGQGTLVTVSS/ASTKGPSVFPLAPSSKSTSGGTAALGCLVKDYFPEPVTVSWNSGA
LTSGVHTFPAVLQSSGLYSLSSVVTVPSSSLGTQTYICNVNHKPSDTKVDKKVEPKSCDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYKCKVSNKA
LPAPIEKTISKAKGQPREPQVYTLPPSREEMTKNQVSLTCDVSGFYPSDIAVEWESDGQPENNYKTTPPVLDSDGSFFLYSK
LTVDKSRWEQGDVFSCSVMHEALHNHYTQKSLSLSPGK

Chain 2 - 1C11[PD-1]_H3.241_L3.92_scFv(GKPGS)4_Fc(216)_IgG1_C220S/PVA_/S267K/S364K/E357Q (SEQ ID NOS 44109-44118 and linker disclosed as SEQ ID NO: 39202)
EVQLVQSGPELKKPGESVKVSCKASGYTFTHYGINWVRQPPGQGLEWMGWINTYTGEPYYAPGFQERFVFSIDTSQDTAYLQ
INSLKAEDTAVYYCARDYYGSSPYWGQGTLVTVSS/GKPGSGKPGSGKPGSGKPGS/DIVMTQSPDSLAVSLGERVTINCKA
SQSIVHSNGNTYLEWYQQKPGQPPKLLIYKVSNRFTGVPDRFSGSGSGTDFTLTISSLQAEDVAVYYCFQGSHVPNTFGGGT
KVEIK/EPKSSDKTHTCPPCPAPPVAGPSVFLFPPKPKDTLMISRTPEVTCVVVDVKHEDPEVKFNWYVDGVEVHNAKTKPR
EEQYNSTYRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK

Chain 3 - [CTLA-4]_L0.22 (SEQ ID NOS 44119-44123)
EIVLTQSPGTLSLSPGERATLSCRASQSVSSSYLAWYQQKPGQAPRLLIYGAFSRATGIPDRFSGSGSGTDFTLTISRLEPE
DFAVYYCQQYGSSPWTFGQGTKVEIK/RTVAAPSVFIFPPSDEQLKSGTASVVCLLNNFYPREAKVQWKVDNALQSGNSQES
VTEQDSKDSTYSLSSTLTLSKADYEKHKVYACEVTHQGLSSPVTKSFNRGEC XENCS524 PD-1 X LAG-3
> 7G8_H3.30_L1.34_[LAG-3]_Fab-1C11[PD-1]_H3.241_L3.92_scFv(GKPGS)4-IgG1_pI(-
)_Isosteric_A_/PVA_/S267K/L368D/K370S-Fc(216)_IgG1_C220S/PVA_/S267K/S364K/E357Q

Chain 1 – 7G8_H3.30_ IgG1_pI(-)_Isosteric_A_/PVA_/S267K/L368D/K370S (SEQ ID NOS 44124-44128)
EVQLVESGGGLVQPGGSLRLSCAASGFTFDDAWMSWVRQAPGKGLEWVAEISTKANNHATYYAESVKGRFTISRDDSKSSVY
LQMNSLRAEDTAVYYCTRLATWDWYFDVWGQGTTVTVSS/ASTKGPSVFPLAPSSKSTSGGTAALGCLVKDYFPEPVTVSWN
SGALTSGVHTFPAVLQSSGLYSLSSVVTVPSSSLGTQTYICNVNHKPSDTKVDKKVEPKSCDKTHTCPPCPAPPVAGPSVFL
FPPKPKDTLMISRTPEVTCVVVDVKHEDPEVKFNWYVDGVEVHNAKTKPREEEYNSTYRVVSVLTVLHQDWLNGKEYKCKVS
NKALPAPIEKTISKAKGQPREPQVYTLPPSREEMTKNQVSLTCDVSGFYPSDIAVEWESDGQPENNYKTTPPVLDSDGSFFL
YSKLTVDKSRWEQGDVFSCSVMHEALHNHYTQKSLSLSPGK

Chain 2 –1C11[PD-1]_H3.241_L3.92_scFv(GKPGS)4_Fc(216)_IgG1_C220S/PVA_/S267K/S364K/E357Q (SEQ ID NOS 44129-44138 and linker disclosed as SEQ ID NO: 39202)
EVQLVQSGPELKKPGESVKVSCKASGYTFTHYGINWVRQPPGQGLEWMGWINTYTGEPYYAPGFQERFVFSIDTSQDTAYLQ
INSLKAEDTAVYYCARDYYGSSPYWGQGTLVTVSS/GKPGSGKPGSGKPGSGKPGS/DIVMTQSPDSLAVSLGERVTINCKA
SQSIVHSNGNTYLEWYQQKPGQPPKLLIYKVSNRFTGVPDRFSGSGSGTDFTLTISSLQAEDVAVYYCFQGSHVPNTFGGGT
KVEIK/EPKSSDKTHTCPPCPAPPVAGPSVFLFPPKPKDTLMISRTPEVTCVVVDVKHEDPEVKFNWYVDGVEVHNAKTKPR
EEQYNSTYRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK

FIG. 49Q

Chain 3 – 7G8_L1.34 (SEQ ID NOS 44139-44143)
DIVLTQSPSSLSASVGDRVTITCRASQSVDYDGDSYMNWYQQKPGKPPKLLIYAASELESGIPARFSGSGSGTDFTL
TISSLQPEDFATYYCQQSNEDPFTFGSGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

XENCS525 PD-1 X LAG-3

> 2A11_H1.144_L2.142_[LAG-3]_Fab-1C11[PD-1]_H3.241_L3.92_scFv(GKPGS)4-IgG1_pI(-)_Isosteric_A_/PVA_/S267K/L368D/K370S-Fc(216)_IgG1_C220S/PVA_/S267K/S364K/E357Q

Chain 1 – 2A11_H1.144_ IgG1_pI(-)_Isosteric_A_/PVA_/S267K/L368D/K370S (SEQ ID NOS 44144-44148)
EVQLVQSGAEVKKPGATVKISCKASGFNIKDYFMHWVQQAPGKGLEWMGWIDPELGDTEYAPKFQGRVTITADTSTN
TAYMELSSLRSEDTAVYYCYARGVYQALDYWGQGTLVTVSS/ASTKGPSVFPLAPSSKSTSGGTAALGCLVKDYFPE
PVTVSWNSGALTSGVHTFPAVLQSSGLYSLSSVVTVPSSSLGTQTYICNVNHKPSDTKVDKKVEPKSCDKTHTCPPC
PAPPVAGPSVFLFPPKPKDTLMISRTPEVTCVVVDVKHEDPEVKFNWYVDGVEVHNAKTKPREEEYNSTYRVVSVLT
VLHQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 – 1C11[PD-1]_H3.241_L3.92_scFv(GKPGS)4_Fc(216)_IgG1_C220S/PVA_/S267K/S364K/E357Q (SEQ ID NOS 44149-44158 and linker disclosed as SEQ ID NO: 39202)
EVQLVQSGPELKKPGESVKVSCKASGYTFTHYGINWVRQPPGQGLEWMGWINTYTGEPYYAPGFQERFVFSIDTSQD
TAYLQINSLKAEDTAVYYCARDYYGSSPYWGQGTLVTVSS/GKPGSGKPGSGKPGSGKPGS/DIVMTQSPDSLAVSL
GERVTINCKASQSIVHSNGNTYLEWYQQKPGQPPKLLIYKVSNRFTGVPDRFSGSGSGTDFTLTISSLQAEDVAVYY
CFQGSHVPNTFGGGTKVEIK/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VMHEALHNHYTQKSLSLSPGK

Chain 3 – 2A11_L2.142 (SEQ ID NOS 44159-44163)
DIQMTQSPAFLSVTPGEKVTITCQASQDIGNYLNWFQQKPGQTVKLLIYFTSYLHSGVPSRFSGSGSGTDYTFTISS
LEAEDAATYFCQQGNTLPYTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

XENCS526 PD-1 X TIM-3

> 3H3_H1_L2.1_Fab-1C11[PD-1]_H3.241_L3.92-scFv(GKPGS)4-IgG1_pI(-)_Isosteric_A_/PVA_/S267K/L368D/K370S-Fc(216)_IgG1_C220S/PVA_/S267K/S364K/E357Q

Chain 1 – 3H3_H1_ IgG1_pI(-)_Isosteric_A_/PVA_/S267K/L368D/K370S (SEQ ID NOS 44164-44168)
QVTLKESGPVLVKPTETLTLTCTVSGFSLNGYGVNWVRQPPGKGLEWLAMIWGDGSTDYNSALKSRLTISKDNSKSQ
VVLTMTNMDPVDTATYYCARSYYTSDEDYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSDTKVDKKVEPKSCDKTHTCPPCP
APPVAGPSVFLFPPKPKDTLMISRTPEVTCVVVDVKHEDPEVKFNWYVDGVEVHNAKTKPREEEYNSTYRVVSVLTV
LHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK

FIG. 49R

Chain 2 – 1C11[PD-1]_H3.241_L3.92_scFv(GKPGS)4_Fc(216)_IgG1_C220S/PVA_/S267K/S364K/E357Q (SEQ ID NOS 44169-44178 and linker disclosed as SEQ ID NO: 39202)
EVQLVQSGPELKKPGESVKVSCKASGYTFTHYGINWVRQPPGQGLEWMGWINTYTGEPYYAPGFQERFVFSIDTSQD
TAYLQINSLKAEDTAVYYCARDYYGSSPYWGQGTLVTVSS/GKPGSGKPGSGKPGSGKPGS/DIVMTQSPDSLAVSL
GERVTINCKASQSIVHSNGNTYLEWYQQKPGQPPKLLIYKVSNRFTGVPDRFSGSGSGTDFTLTISSLQAEDVAVYY
CFQGSHVPNTFGGGTKVEIK/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VMHEALHNHYTQKSLSLSPGK

Chain 3 – 3H3_L2.1 (SEQ ID NOS 44179-44183)
DIVMTQSPDSLAVSLGERATINCKSSQSLLNSRTRKNYLAWYQQKPGQSPKLLIYWASTRESGVPDRFTGSGSGTDF
TLTISSLQAEDVAVYYCKQSYSLRTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

XENCS527 PD-1 X BTLA

> 9C6_H1.1_L1_[BTLA]_Fab-1C11[PD-1]_H3.241_L3.92_scFv(GKPGS)4-IgG1_pI(-)_Isosteric_A_/PVA_/S267K/L368D/K370S-Fc(216)_IgG1_C220S/PVA_/S267K/S364K/E357Q

Chain 1 – 9C6_H1.1_IgG1_pI(-)_Isosteric_A_/PVA_/S267K/L368D/K370S (SEQ ID NOS 44184-44188)
QVQLKESGAEVKKPGASVKVSCKVSGFSLTGYGVNWVRQAPGQGLEWMGMIWIDGSTDYNSKFQGRVTMTKDNSKST
VYMELSSLRSEDTAVYYCARDRPDGRAMDYWGQGTMVTVSS/ASTKGPSVFPLAPSSKSTSGGTAALGCLVKDYFPE
PVTVSWNSGALTSGVHTFPAVLQSSGLYSLSSVVTVPSSSLGTQTYICNVNHKPSDTKVDKKVEPKSCDKTHTCPPC
PAPPVAGPSVFLFPPKPKDTLMISRTPEVTCVVVDVKHEDPEVKFNWYVDGVEVHNAKTKPREEEYNSTYRVVSVLT
VLHQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 – 1C11[PD-1]_H3.241_L3.92_scFv(GKPGS)4_Fc(216)_IgG1_C220S/PVA_/S267K/S364K/E357Q (SEQ ID NOS 44189-44198 and linker disclosed as SEQ ID NO: 39202)
EVQLVQSGPELKKPGESVKVSCKASGYTFTHYGINWVRQPPGQGLEWMGWINTYTGEPYYAPGFQERFVFSIDTSQD
TAYLQINSLKAEDTAVYYCARDYYGSSPYWGQGTLVTVSS/GKPGSGKPGSGKPGSGKPGS/DIVMTQSPDSLAVSL
GERVTINCKASQSIVHSNGNTYLEWYQQKPGQPPKLLIYKVSNRFTGVPDRFSGSGSGTDFTLTISSLQAEDVAVYY
CFQGSHVPNTFGGGTKVEIK/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VMHEALHNHYTQKSLSLSPGK

Chain 3 – 9C6_L1 (SEQ ID NOS 44199-44203)
SIVMTQSPDSLAVSLGERATINCKASQSVSNDVAWYQQKPGQSPKLLIYYASNRYTGVPDRFTGSGYGTDFTLTISS
LQAEDVAVYFCQQDYSSPTFGGGTKLEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

FIG. 49S

```
XENCS528 PD-1 X ICOS (Xtend)
```

> [ICOS]_H0L0_Fab-1C11[PD-1]_H3.234_L3.144-scFv(GKPGS)4-IgG1_pI(-)_Isosteric_A_/PVA_/S267K/L368D/K370S/M428L/N434S-Fc(216)_IgG1_C220S/PVA_/S267K/S364K/E357Q/M428L/N434S

Chain 1 – [ICOS]_H0_ IgG1_pI(-)_Isosteric_A_/PVA_/S267K/L368D/K370S/M428L/N434S (SEQ ID NOS 44204-44208)

QVQLVQSGAEVKKPGASVKVSCKASGYTFTGYYMHWVRQAPGQGLEWMGWINPHSGGTNYAQKFQGRVTMTRDTSIS
TAYMELSRLRSDDTAVYYCARTYYYDSSGYYHDAFDIWGQGTMVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYKCKVSNKALPAPIEKTISK
AKGQPREPQVYTLPPSREEMTKNQVSLTCDVSGFYPSDIAVEWESDGQPENNYKTTPPVLDSDGSFFLYSKLTVDKSRWQEGDVFSCSVLHEA
LHSHYTQKSLSLSPGK

Chain 2 – 1C11[PD-1]_H3.234_L3.144_scFv(GKPGS)4_Fc(216)_IgG1_C220S/PVA_/S267K/S364K/E357Q/M428L/N434S (SEQ ID NOS 44209-44218 and linker disclosed as SEQ ID NO: 39202)

EVQLVQSGSELKKPGESVKVSCKASGYTFTHYGINWVRQPPGQGLEWMGWINTYTGEPYYAPGFQERFVFSLDTSQD
TAYLQINSLKAEDTAVYYCARDYYGSSPYWGQGTLVTVSS/GKPGSGKPGSGKPGSGKPGS/DIVMTQSPDSLAVSL
GERVTINCKASQSIVHSNGNTYLEWYQQKPGQPPKLLIYKVSNRFSGVPDRFSGSGSGTDFTLTISSVEAEDAATYY
CFQGSHVPNTFGQGTKVEIK/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VLHEALHSHYTQKSLSLSPGK

Chain 3 – [ICOS]_L0 (SEQ ID NOS 44219-44223)

DIQMTQSPSSVSASVGDRVTITCRASQGISRLLAWYQQKPGKAPKLLIYVASSLQSGVPSRFSGSGSGTDFTLTISS
LQPEDFATYYCQQANSFPWTFGQGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

```
XENCS529 PD-1 X ICOS (Xtend)
```

> [ICOS]_H0.66_L0_Fab-1C11[PD-1]_H3.234_L3.144-scFv(GKPGS)4-IgG1_pI(-)_Isosteric_A_/PVA_/S267K/L368D/K370S/M428L/N434S-Fc(216)_IgG1_C220S/PVA_/S267K/S364K/E357Q/M428L/N434S

Chain 1 – [ICOS]_H0.66_ IgG1_pI(-)_Isosteric_A_/PVA_/S267K/L368D/K370S/M428L/N434S (SEQ ID NOS 44224-44228)

QVQLVQSGAEVKKPGASVKVSCKASGYTFTGYYMHWVRQAPGQGLEWMGWINPHSGETIYAQKFQGRVTMTRDTSIS
TAYMELSSLRSEDTAVYYCARTYYYDTSGYYHDAFDVWGQGTMVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSCDK
THTCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPSDI
AVEWESDGQPENNYKTTPPVLDSDGSFFLYSKLTVDKSRWQEGDVFSCSVLHEALHSHYTQKSLSLSPGK

FIG. 49T

Chain 2 – 1C11[PD-1]_H3.234_L3.144_scFv(GKPGS)4_Fc(216)_IgG1_C220S/PVA_/S267K/S364K/E357Q/M428L/N434S (SEQ ID NOS 44229-44238 and linker disclosed as SEQ ID NO: 39202)

EVQLVQSGSELKKPGESVKVSCKASGYTFTHYGINWVRQPPGQGLEWMGWINTYTGEPYYAPGFQERFVFSLDTSQD
TAYLQINSLKAEDTAVYYCARDYYGSSPYWGQGTLVTVSS/GKPGSGKPGSGKPGSGKPGS/DIVMTQSPDSLAVSL
GERVTINCKASQSIVHSNGNTYLEWYQQKPGQPPKLLIYKVSNRFSGVPDRFSGSGSGTDFTLTISSVEAEDAATYY
CFQGSHVPNTFGQGTKVEIK/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VLHEALHSHYTQKSLSLSPGK

Chain 3 – [ICOS]_L0 (SEQ ID NOS 44239-44243)

DIQMTQSPSSVSASVGDRVTITCRASQGISRLLAWYQQKPGKAPKLLIYVASSLQSGVPSRFSGSGSGTDFTLTISS
LQPEDFATYYCQQANSFPWTFGQGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

XENCS530 PD-1 X CTLA-4 (Xtend)

>[CTLA-4]_H3_L0.22_Fab-1C11[PD-1]_H3.234_L3.144_scFv(GKPGS)4-IgG1_pI(-)_Isosteric_A_/PVA_/S267K/L368D/K370S/M428L/N434S-Fc(216)_IgG1_C220S/PVA_/S267K/S364K/E357Q/M428L/N434S

Chain 1 - [CTLA-4]_H3_IgG1_pI(-)_Isosteric_A_/PVA_/S267K/L368D/K370S/M428L/N434S (SEQ ID NOS 44244-44248)

EVQLVESGGGLVKPGGSLRLSCAASGFTFSSYTMHWVRQAPGKGLEWVSFISYDGNNKYYADSVKGRFTISRDNAKN
SLYLQMNSLRAEDTAVYYCARTGWLGPFDYWGQGTLVTVSS/ASTKGPSVFPLAPSSKSTSGGTAALGCLVKDYFPE
PVTVSWNSGALTSGVHTFPAVLQSSGLYSLSSVVTVPSSSLGTQTYICNVNHKPSDTKVDKKVEPKSCDKTHTCPPC
PAPPVAGPSVFLFPPKPKDTLMISRTPEVTCVVVDVKHEDPEVKFNWYVDGVEVHNAKTKPREEEYNSTYRVVSVLT
VLHQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVLHEALHSHYTQKSLSLSPGK

Chain 2 - 1C11[PD-1]_H3.234_L3.144_scFv(GKPGS)4_Fc(216)_IgG1_C220S/PVA_/S267K/S364K/E357Q/M428L/N434S (SEQ ID NOS 44249-44258 and linker disclosed as SEQ ID NO: 39202)

EVQLVQSGSELKKPGESVKVSCKASGYTFTHYGINWVRQPPGQGLEWMGWINTYTGEPYYAPGFQERFVFSLDTSQD
TAYLQINSLKAEDTAVYYCARDYYGSSPYWGQGTLVTVSS/GKPGSGKPGSGKPGSGKPGS/DIVMTQSPDSLAVSL
GERVTINCKASQSIVHSNGNTYLEWYQQKPGQPPKLLIYKVSNRFSGVPDRFSGSGSGTDFTLTISSVEAEDAATYY
CFQGSHVPNTFGQGTKVEIK/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VLHEALHSHYTQKSLSLSPGK

Chain 3 - [CTLA-4]_L0.22 (SEQ ID NOS 44259-44263)

EIVLTQSPGTLSLSPGERATLSCRASQSVSSSYLAWYQQKPGQAPRLLIYGAFSRATGIPDRFSGSGSGTDFTLTIS
RLEPEDFAVYYCQQYGSSPWTFGQGTKVEIK/RTVAAPSVFIFPPSDEQLKSGTASVVCLLNNFYPREAKVQWKVDN
ALQSGNSQESVTEQDSKDSTYSLSSTLTLSKADYEKHKVYACEVTHQGLSSPVTKSFNRGEC

FIG. 49U

XENCS531 PD-1 X LAG-3 (Xtend)

<u>> 7G8_H3.30_L1.34_[LAG-3]_Fab-1C11[PD-1]_H3.234_L3.144_scFv(GKPGS)4-IgG1_pI(-
)_Isosteric_A_/PVA_/S267K/L368D/K370S/M428L/N434S-
Fc(216)_IgG1_C220S/PVA_/S267K/S364K/E357Q/M428L/N434S</u>

Chain 1 – 7G8_H3.30_ IgG1_pI(-)_Isosteric_A_/PVA_/S267K/L368D/K370S/M428L/N434S (SEQ ID NOS 44264-44268)
EVQLVESGGGLVQPGGSLRLSCAASGFTFD<u>D</u>A<u>WMS</u>WVRQAPGKGLEWVA<u>EISTKANNHATYYAESVKG</u>RFTISRDDS
KSSVYLQMNSLRAEDTAVYYCTR<u>LATWDWYFDV</u>WGQGTTVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVLHEALHSHYTQKSLSLSPGK

**Chain 2 –1C11[PD-
1]_H3.234_L3.144_scFv(GKPGS)4_Fc(216)_IgG1_C220S/PVA_/S267K/S364K/E357Q/M428L/N434S** (SEQ ID NOS
44269-44278 and linker disclosed as SEQ ID NO: 39202)
EVQLVQSGSELKKPGESVKVSCKASGYTFT<u>HYGIN</u>WVRQPPGQGLEWMG<u>WINTYTGEPYYAPGFQE</u>RFVFSLDTSQD
TAYLQINSLKAEDTAVYYCARD<u>YYGSSPY</u>WGQGTLVTVSS/<u>GKPGSGKPGSGKPGSGKPGS</u>/DIVMTQSPDSLAVSL
GERVTINC<u>KASQSIVHSNGNTYLE</u>WYQQKPGQPPKLLIY<u>KVSNRFS</u>GVPDRFSGSGSGTDFTLTISSVEAEDAATYY
C<u>FQGSHVPNT</u>FGQGTKVEIK/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VLHEALHSHYTQKSLSLSPGK

Chain 3 – 7G8_L1.34 (SEQ ID NOS 44279-44283)
DIVLTQSPSSLSASVGDRVTITC<u>RASQSVDYDGDSYMN</u>WYQQKPGKPPKLLIY<u>AASELES</u>GIPARFSGSGSGTDFTL
TISSLQPEDFATYYC<u>QQSNEDPFT</u>FGSGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC XENCS532 PD-1 X LAG-3 (Xtend)

<u>> 2A11_H1.144_L2.142_[LAG-3]_Fab-1C11[PD-1]_H3.234_L3.144_scFv(GKPGS)4-IgG1_pI(-
)_Isosteric_A_/PVA_/S267K/L368D/K370S/M428L/N434S-
Fc(216)_IgG1_C220S/PVA_/S267K/S364K/E357Q/M428L/N434S</u>

Chain 1 – 2A11_H1.144_ IgG1_pI(-)_Isosteric_A_/PVA_/S267K/L368D/K370S/M428L/N434S (SEQ ID NOS 44284-44288)
EVQLVQSGAEVKKPGATVKISCKASGFNIK<u>DYFMH</u>WVQQAPGKGLEWMG<u>WIDPELGDTEYAPKFQG</u>RVTITADTSTN
TAYMELSSLRSEDTAVYYCY<u>ARGVYQALDY</u>WGQGTLVTVSS/ASTKGPSVFPLAPSSKSTSGGTAALGCLVKDYFPE
PVTVSWNSGALTSGVHTFPAVLQSSGLYSLSSVVTVPSSSLGTQTYICNVNHKPSDTKVDKKVEPKSCDKTHTCPPC
PAPPVAGPSVFLFPPKPKDTLMISRTPEVTCVVVDVKHEDPEVKFNWYVDGVEVHNAKTKPREEEYNSTYRVVSVLT
VLHQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVLHEALHSHYTQKSLSLSPGK

FIG. 49V

Chain 2 – 1C11[PD-1]_H3.234_L3.144_scFv(GKPGS)4_Fc(216)_IgG1_C220S/PVA_/S267K/S364K/E357Q/M428L/N434S (SEQ ID NOS 44289-44298 and linker disclosed as SEQ ID NO: 39202)EVQLVQSGSELKKPGESVKVSCKASGYTFTHYGINWVRQPPGQGLEWMGWINTYTGEPYYAPGFQERFVFSLD
TSQDTAYLQINSLKAEDTAVYYCARDYYGSSPYWGQGTLVTVSS/GKPGSGKPGSGKPGSGKPGS/DIVMTQSPDSL
AVSLGERVTINCKASQSIVHSNGNTYLEWYQQKPGQPPKLLIYKVSNRFSGVPDRFSGSGSGTDFTLTISSVEAEDA
ATYYCFQGSHVPNTFGQGTKVEIK/EPKSSDKTHTCPPCPAPPVAGPSVFLFPPKPKDTLMISRTPEVTCVVVDVKH
EDPEVKFNWYVDGVEVHNAKTKPREEQYNSTYRVVSVLTVLHQDWLNGKEYKCKVSNKALPAPIEKTISKAKGQPRE
PQVYTLPPSREQMTKNQVKLTCLVKGFYPSDIAVEWESNGQPENNYKTTPPVLDSDGSFFLYSKLTVDKSRWQQGNV
FSCSVLHEALHSHYTQKSLSLSPGK

Chain 3 – 2A11_L2.142 (SEQ ID NOS 44299-44303)
DIQMTQSPAFLSVTPGEKVTITCQASQDIGNYLNWFQQKPGQTVKLLIYFTSYLHSGVPSRFSGSGSGTDYTFTISS
LEAEDAATYFCQQGNTLPYTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC XENCS533 PD-1 X TIM-3 (Xtend)

> 3H3_H1_L2.1_Fab-1C11[PD-1]_H3.234_L3.144-scFv(GKPGS)4-IgG1_pI(-)_Isosteric_A_/PVA_/S267K/L368D/K370S/M428L/N434S-Fc(216)_IgG1_C220S/PVA_/S267K/S364K/E357Q/M428L/N434S

Chain 1 – 3H3_H1_IgG1_pI(-)_Isosteric_A_/PVA_/S267K/L368D/K370S/M428L/N434S (SEQ ID NOS 44304-44308)
QVTLKESGPVLVKPTETLTLTCTVSGFSLNGYGVNWVRQPPGKGLEWLAMIWGDGSTDYNSALKSRLTISKDNSKSQ
VVLTMTNMDPVDTATYYCARSYYTSDEDYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSDTKVDKKVEPKSCDKTHTCPPCP
APPVAGPSVFLFPPKPKDTLMISRTPEVTCVVVDVKHEDPEVKFNWYVDGVEVHNAKTKPREEEYNSTYRVVSVLTV
LHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVLHEALHSHYTQKSLSLSPGK

Chain 2 – 1C11[PD-1]_H3.234_L3.144_scFv(GKPGS)4_Fc(216)_IgG1_C220S/PVA_/S267K/S364K/E357Q/M428L/N434S (SEQ ID NOS 44309-44318 and linker disclosed as SEQ ID NO: 39202)
EVQLVQSGSELKKPGESVKVSCKASGYTFTHYGINWVRQPPGQGLEWMGWINTYTGEPYYAPGFQERFVFSLDTSQD
TAYLQINSLKAEDTAVYYCARDYYGSSPYWGQGTLVTVSS/GKPGSGKPGSGKPGSGKPGS/DIVMTQSPDSLAVSL
GERVTINCKASQSIVHSNGNTYLEWYQQKPGQPPKLLIYKVSNRFSGVPDRFSGSGSGTDFTLTISSVEAEDAATYY
CFQGSHVPNTFGQGTKVEIK/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VLHEALHSHYTQKSLSLSPGK

Chain 3 – 3H3_L2.1 (SEQ ID NOS 44319-44323)
DIVMTQSPDSLAVSLGERATINCKSSQSLLNSRTRKNYLAWYQQKPGQSPKLLIYWASTRESGVPDRFTGSGSGTDF
TLTISSLQAEDVAVYYCKQSYSLRTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

FIG. 49W

```
XENCS534 PD-1 X BTLA (Xtend)
```

**> 9C6_H1.1_L1_[BTLA]_Fab-1C11[PD-1]_H3.234_L3.144_scFv(GKPGS)4-IgG1_pI(-
)_Isosteric_A_/PVA_/S267K/L368D/K370S/M428L/N434S-
Fc(216)_IgG1_C220S/PVA_/S267K/S364K/E357Q/M428L/N434S**

Chain 1 – 9C6_H1.1_ IgG1_pI(-)_Isosteric_A_/PVA_/S267K/L368D/K370S/M428L/N434S (SEQ ID NOS 44324-44328)
QVQLKESGAEVKKPGASVKVSCKVSGFSLT<u>GYGVN</u>WVRQAPGQGLEWMG<u>MIWIDGSTDYNSKFQ</u>GRVTMTKDNSKST
VYMELSSLRSEDTAVYYCARD<u>RPDGRAMDY</u>WGQGTMVTVSS/ASTKGPSVFPLAPSSKSTSGGTAALGCLVKDYFPE
PVTVSWNSGALTSGVHTFPAVLQSSGLYSLSSVVTVPSSSLGTQTYICNVNHKPSDTKVDKKVEPKSCDKTHTCPPC
PAPPVAGPSVFLFPPKPKDTLMISRTPEVTCVVVDVKHEDPEVKFNWYVDGVEVHNAKTKPREEEYNSTYRVVSVLT
VLHQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVLHEALHSHYTQKSLSLSPGK

**Chain 2 – 1C11[PD-
1]_H3.234_L3.144_scFv(GKPGS)4_Fc(216)_IgG1_C220S/PVA_/S267K/S364K/E357Q/M428L/N434S** (SEQ ID NOS 44329-44338 and linker disclosed as SEQ ID NO: 39202)
EVQLVQSGSELKKPGESVKVSCKASGYTFT<u>HYGIN</u>WVRQPPGQGLEWMG<u>WINTYTGEPYYAPGFQE</u>RFVFSLDTSQD
TAYLQINSLKAEDTAVYYCARD<u>YYGSSPYW</u>GQGTLVTVSS/GKPGSGKPGSGKPGSGKPGS/DIVMTQSPDSLAVSL
GERVTINC<u>KASQSIVHSNGNTYLE</u>WYQQKPGQPPKLLIY<u>KVSNRFS</u>GVPDRFSGSGSGTDFTLTISSVEAEDAATYY
C<u>FQGSHVPNTF</u>GQGTKVEIK/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VLHEALHSHYTQKSLSLSPGK

Chain 3 – 9C6_L1 (SEQ ID NOS 44339-44343)
SIVMTQSPDSLAVSLGERATINC<u>KASQSVSNDVAW</u>YQQKPGQSPKLLIY<u>YASNRYT</u>GVPDRFTGSGYGTDFTLTISS
LQAEDVAVYFC<u>QQDYSSPTF</u>GGGTKLEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

```
XENCS535 PD-1 X ICOS (Xtend)
```

**> [ICOS]_H0L0_Fab-1C11[PD-1]_H3.240_L3.148-scFv(GKPGS)4-IgG1_pI(-
)_Isosteric_A_/PVA_/S267K/L368D/K370S/M428L/N434S-
Fc(216)_IgG1_C220S/PVA_/S267K/S364K/E357Q/M428L/N434S**

Chain 1 – [ICOS]_H0_ IgG1_pI(-)_Isosteric_A_/PVA_/S267K/L368D/K370S/M428L/N434S (SEQ ID NOS 44344-44348)
QVQLVQSGAEVKKPGASVKVSCKASGYTFT<u>GYYMH</u>WVRQAPGQGLEWMG<u>WINPHSGGTNYAQKFQ</u>GRVTMTRDTSIS
TAYMELSRLRSDDTAVYYCART<u>YYYDSSGYYHDAFDI</u>WGQGTMVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYKCKVSNKALPAPIEKTISK
AKGQPREPQVYTLPPSREEMTKNQVSLTCDVSGFYPSDIAVEWESDGQPENNYKTTPPVLDSDGSFFLYSKLTVDKSRWEQGDVFSCSVLHEA
LHSHYTQKSLSLSPGK

FIG. 49X

Chain 2 – 1C11[PD-1]_H3.240_L3.148_scFv(GKPGS)4_Fc(216)_IgG1_C220S/PVA_/S267K/S364K/E357Q/M428L/N434S (SEQ ID NOS 44349-44358 and linker disclosed as SEQ ID NO: 39202)
QVQLVQSGPELKKPGESVKVSCKASGYTFTHYGINWVRQPPGQGLEWMGWINTYTGEPYYAPGFQERFVFSIDTSQD
TAYLQINSLKAEDTAVYYCARDYYGSSPYWGQGTLVTVSS/GKPGSGKPGSGKPGSGKPGS/DVLMTQSPDSLAVSL
GERATINCKSSQSIVHSNGNTYLEWYQQKPGQSPKLLIYKVSNRFSGVPDRFSGSGSGTDFTLTISSLQAEDVAVYY
CFQGSHVPNTFGGGTKVEIK/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VLHEALHSHYTQKSLSLSPGK

Chain 3 – [ICOS]_L0 (SEQ ID NOS 44359-44363)
DIQMTQSPSSVSASVGDRVTITCRASQGISRLLAWYQQKPGKAPKLLIYVASSLQSGVPSRFSGSGSGTDFTLTISS
LQPEDFATYYCQQANSFPWTFGQGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

```
XENCS536 PD-1 X ICOS (Xtend)
```

> [ICOS]_H0.66_L0_Fab-1C11[PD-1]_H3.240_L3.148-scFv(GKPGS)4-IgG1_pI(-)_Isosteric_A_/PVA_/S267K/L368D/K370S/M428L/N434S-Fc(216)_IgG1_C220S/PVA_/S267K/S364K/E357Q/M428L/N434S

Chain 1 – [ICOS]_H0.66_IgG1_pI(-)_Isosteric_A_/PVA_/S267K/L368D/K370S/M428L/N434S (SEQ ID NOS 44364-44368)
QVQLVQSGAEVKKPGASVKVSCKASGYTFTGYYMHWVRQAPGQGLEWMGWINPHSGETIYAQKFQGRVTMTRDTSIS
TAYMELSSLRSEDTAVYYCARTYYYDTSGYYHDAFDVWGQGTMVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSCDK
THTCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPSDI
AVEWESDGQPENNYKTTPPVLDSDGSFFLYSKLTVDKSRWEQGDVFSCSVLHEALHSHYTQKSLSLSPGK

Chain 2 – 1C11[PD-1]_H3.240_L3.148_scFv(GKPGS)4_Fc(216)_IgG1_C220S/PVA_/S267K/S364K/E357Q/M428L/N434S (SEQ ID NOS 44369-44378 and linker disclosed as SEQ ID NO: 39202)
QVQLVQSGPELKKPGESVKVSCKASGYTFTHYGINWVRQPPGQGLEWMGWINTYTGEPYYAPGFQERFVFSIDTSQD
TAYLQINSLKAEDTAVYYCARDYYGSSPYWGQGTLVTVSS/GKPGSGKPGSGKPGSGKPGS/DVLMTQSPDSLAVSL
GERATINCKSSQSIVHSNGNTYLEWYQQKPGQSPKLLIYKVSNRFSGVPDRFSGSGSGTDFTLTISSLQAEDVAVYY
CFQGSHVPNTFGGGTKVEIK/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VLHEALHSHYTQKSLSLSPGK

Chain 3 – [ICOS]_L0 (SEQ ID NOS 44379-44383)
DIQMTQSPSSVSASVGDRVTITCRASQGISRLLAWYQQKPGKAPKLLIYVASSLQSGVPSRFSGSGSGTDFTLTISS
LQPEDFATYYCQQANSFPWTFGQGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

FIG. 49Y

```
XENCS537 PD-1 X CTLA-4
```

> [CTLA-4]_H3_L0.22_Fab-1C11[PD-1]_H3.240_L3.148_scFv(GKPGS)4-IgG1_pI(-
)_Isosteric_A_/PVA_/S267K/L368D/K370S/M428L/N434S-
Fc(216)_IgG1_C220S/PVA_/S267K/S364K/E357Q/M428L/N434S

Chain 1 - [CTLA-4]_H3_ IgG1_pI(-)_Isosteric_A_/PVA_/S267K/L368D/K370S/M428L/N434S (SEQ ID NOS 44384-44388)

EVQLVESGGGLVKPGGSLRLSCAASGFTFSSYTMHWVRQAPGKGLEWVSFISYDGNNKYYADSVKGRFTISRDNAKN
SLYLQMNSLRAEDTAVYYCARTGWLGPFDYWGQGTLVTVSS/ASTKGPSVFPLAPSSKSTSGGTAALGCLVKDYFPE
PVTVSWNSGALTSGVHTFPAVLQSSGLYSLSSVVTVPSSSLGTQTYICNVNHKPSDTKVDKKVEPKSCDKTHTCPPC
PAPPPVAGPSVFLFPPKPKDTLMISRTPEVTCVVVDVKHEDPEVKFNWYVDGVEVHNAKTKPREEEYNSTYRVVSVLT
VLHQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVLHEALHSHYTQKSLSLSPGK

Chain 2 - 1C11[PD-1]_H3.240_L3.148_scFv(GKPGS)4_Fc(216)_IgG1_C220S/PVA_/S267K/S364K/E357Q/M428L/N434S (SEQ ID NOS 44389-44398 and linker disclosed as SEQ ID NO: 39202)

QVQLVQSGPELKKPGESVKVSCKASGYTFTHYGINWVRQPPGQGLEWMGWINTYTGEPYYAPGFQERFVFSIDTSQD
TAYLQINSLKAEDTAVYYCARDYYGSSPYWGQGTLVTVSS/GKPGSGKPGSGKPGSGKPGS/DVLMTQSPDSLAVSL
GERATINCKSSQSIVHSNGNTYLEWYQQKPGQSPKLLIYKVSNRFSGVPDRFSGSGSGTDFTLTISSLQAEDVAVYY
CFQGSHVPNTFGGGTKVEIK/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VLHEALHSHYTQKSLSLSPGK

Chain 3 - [CTLA-4]_L0.22 (SEQ ID NOS 44399-44403)
EIVLTQSPGTLSLSPGERATLSCRASQSVSSSYLAWYQQKPGQAPRLLIYGAFSRATGIPDRFSGSGSGTDFTLTIS
RLEPEDFAVYYCQQYGSSPWTFGQGTKVEIK/RTVAAPSVFIFPPSDEQLKSGTASVVCLLNNFYPREAKVQWKVDN
ALQSGNSQESVTEQDSKDSTYSLSSTLTLSKADYEKHKVYACEVTHQGLSSPVTKSFNRGEC

```
XENCS538 PD-1 X LAG-3 (Xtend)
```

> 7G8_H3.30_L1.34_[LAG-3]_Fab-1C11[PD-1]_H3.240_L3.148_scFv(GKPGS)4-IgG1_pI(-
)_Isosteric_A_/PVA_/S267K/L368D/K370S/M428L/N434S-
Fc(216)_IgG1_C220S/PVA_/S267K/S364K/E357Q/M428L/N434S

Chain 1 – 7G8_H3.30_ IgG1_pI(-)_Isosteric_A_/PVA_/S267K/L368D/K370S/M428L/N434S (SEQ ID NOS 44404-44408)

EVQLVESGGGLVQPGGSLRLSCAASGFTFDDAWMSWVRQAPGKGLEWVAEISTKANNHATYYAESVKGRFTISRDDS
KSSVYLQMNSLRAEDTAVYYCTRLATWDWYFDVWGQGTTVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEW
ESDGQPENNYKTTPPVLDSDGSFFLYSKLTVDKSRWEQGDVFSCSVLHEALHSHYTQKSLSLSPGK

FIG. 49Z

Chain 2 –1C11[PD-1]_H3.240_L3.148_scFv(GKPGS)4_Fc(216)_IgG1_C220S/PVA_/S267K/S364K/E357Q/M428L/N434S
(SEQ ID NOS 44409-44418 and linker disclosed as SEQ ID NO: 39202)
QVQLVQSGPELKKPGESVKVSCKASGYTFT<u>HYGIN</u>WVRQPPGQGLEWMG<u>WINTYTGEPYYAPGFQE</u>RFVFSIDTSQDTAYLQ
INSLKAEDTAVYYCAR<u>DYYGSSPYW</u>GQGTLVTVSS/<u>GKPGSGKPGSGKPGSGKPGS</u>/DVLMTQSPDSLAVSLGERATINCK<u>S
SQSIVHSNGNTYLE</u>WYQQKPGQSPKLLIY<u>KVSNRF</u>SGVPDRFSGSGSGTDFTLTISSLQAEDVAVYYC<u>FQGSHVPNTF</u>GGGT
KVEIK/EPKSSDKTHTCPPCPAPPVAGPSVFLFPPKPKDTLMISRTPEVTCVVVDVKHEDPEVKFNWYVDGVEVHNAKTKPR
EEQYNSTYRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVLHEALHSHYTQKSLSLSPGK

Chain 3 – 7G8_L1.34 (SEQ ID NOS 44419-44423)
DIVLTQSPSSLSASVGDRVTITC<u>RASQSVDYDGDSYMN</u>WYQQKPGKPPKLLIY<u>AASELES</u>GIPARFSGSGSGTDFTLTISSL
QPEDFATYYC<u>QQSNEDPFT</u>FGSGTKLEIK/RTVAAPSVFIFPPSDEQLKSGTASVVCLLNNFYPREAKVQWKVDNALQSGNS
QESVTEQDSKDSTYSLSSTLTLSKADYEKHKVYACEVTHQGLSSPVTKSFNRGEC XENCS539 PD-1 X LAG-3 (Xtend)

> 2A11_H1.144_L2.142_[LAG-3]_Fab-1C11[PD-1]_H3.240_L3.148_scFv(GKPGS)4-IgG1_pI(-)_Isosteric_A_/PVA_/S267K/L368D/K370S/M428L/N434S-Fc(216)_IgG1_C220S/PVA_/S267K/S364K/E357Q/M428L/N434S

Chain 1 – 2A11_H1.144_ IgG1_pI(-)_Isosteric_A_/PVA_/S267K/L368D/K370S/M428L/N434S (SEQ ID NOS 44424-44428)
EVQLVQSGAEVKKPGATVKISCKASGFNIK<u>DYFMH</u>WVQQAPGKGLEWMG<u>WIDPELGDTEYAPKFQG</u>RVTITADTSTNTAYME
LSSLRSEDTAVYYCYAR<u>GVYQALDY</u>WGQGTLVTVSS/ASTKGPSVFPLAPSSKSTSGGTAALGCLVKDYFPEPVTVSWNSGA
LTSGVHTFPAVLQSSGLYSLSSVVTVPSSSLGTQTYICNVNHKPSDTKVDKKVEPKSCDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYKCKVSNKA
LPAPIEKTISKAKGQPREPQVYTLPPSREEMTKNQVSLTCDVSGFYPSDIAVEWESDGQPENNYKTTPPVLDSDGSFFLYSK
LTVDKSRWEQGDVFSCSVLHEALHSHYTQKSLSLSPGK

Chain 2 – 1C11[PD-1]_H3.240_L3.148_scFv(GKPGS)4_Fc(216)_IgG1_C220S/PVA_/S267K/S364K/E357Q/M428L/N434S
(SEQ ID NOS 44429-44438 and linker disclosed as SEQ ID NO: 39202)
QVQLVQSGPELKKPGESVKVSCKASGYTFT<u>HYGIN</u>WVRQPPGQGLEWMG<u>WINTYTGEPYYAPGFQE</u>RFVFSIDTSQDTAYLQ
INSLKAEDTAVYYCAR<u>DYYGSSPYW</u>GQGTLVTVSS/<u>GKPGSGKPGSGKPGSGKPGS</u>/DVLMTQSPDSLAVSLGERATINCK<u>S
SQSIVHSNGNTYLE</u>WYQQKPGQSPKLLIY<u>KVSNRF</u>SGVPDRFSGSGSGTDFTLTISSLQAEDVAVYYC<u>FQGSHVPNTF</u>GGGT
KVEIK/EPKSSDKTHTCPPCPAPPVAGPSVFLFPPKPKDTLMISRTPEVTCVVVDVKHEDPEVKFNWYVDGVEVHNAKTKPR
EEQYNSTYRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVLHEALHSHYTQKSLSLSPGK

Chain 3 – 2A11_L2.142 (SEQ ID NOS 44439-44443)
DIQMTQSPAFLSVTPGEKVTITCQA<u>SQDIGNYLN</u>WFQQKPGQTVKLLIY<u>FTSYLHS</u>GVPSRFSGSGSGTDYTFTISSLEAED
AATYFC<u>QQGNTLPYT</u>FGGGTKVEIK/RTVAAPSVFIFPPSDEQLKSGTASVVCLLNNFYPREAKVQWKVDNALQSGNSQESV
TEQDSKDSTYSLSSTLTLSKADYEKHKVYACEVTHQGLSSPVTKSFNRGEC

FIG. 49AA

```
XENCS540 PD-1 X TIM-3 (Xtend)
```

**> 3H3_H1_L2.1_Fab-1C11[PD-1]_H3.240_L3.148-scFv(GKPGS)4-IgG1_pI(-
)_Isosteric_A_/PVA_/S267K/L368D/K370S/M428L/N434S-
Fc(216)_IgG1_C220S/PVA_/S267K/S364K/E357Q/M428L/N434S**

Chain 1 – 3H3_H1_ IgG1_pI(-)_Isosteric_A_/PVA_/S267K/L368D/K370S/M428L/N434S (SEQ ID NOS 44444-44448)
QVTLKESGPVLVKPTETLTLTCTVSGFSLNGYGVNWVRQPPGKGLEWLAMIWGDGSTDYNSALKSRLTISKDNSKSQ
VVLTMTNMDPVDTATYYCARSYYTSDEDYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSDTKVDKKVEPKSCDKTHTCPPCP
APPVAGPSVFLFPPKPKDTLMISRTPEVTCVVVDVKHEDPEVKFNWYVDGVEVHNAKTKPREEEYNSTYRVVSVLTV
LHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVLHEALHSHYTQKSLSLSPGK

**Chain 2 – 1C11[PD-
1]_H3.240_L3.148_scFv(GKPGS)4_Fc(216)_IgG1_C220S/PVA_/S267K/S364K/E357Q/M428L/N434S** (SEQ ID NOS
44449-44458 and linker disclosed as SEQ ID NO: 39202)
QVQLVQSGPELKKPGESVKVSCKASGYTFTHYGINWVRQPPGQGLEWMGWINTYTGEPYYAPGFQERFVFSIDTSQD
TAYLQINSLKAEDTAVYYCARDYYGSSPYWGQGTLVTVSS/GKPGSGKPGSGKPGSGKPGS/DVLMTQSPDSLAVSL
GERATINCKSSQSIVHSNGNTYLEWYQQKPGQSPKLLIYKVSNRFSGVPDRFSGSGSGTDFTLTISSLQAEDVAVYY
CFQGSHVPNTFGGGTKVEIK/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VLHEALHSHYTQKSLSLSPGK

Chain 3 – 3H3_L2.1 (SEQ ID NOS 44459-44463)
DIVMTQSPDSLAVSLGERATINCKSSQSLLNSRTRKNYLAWYQQKPGQSPKLLIYWASTRESGVPDRFTGSGSGTDF
TLTISSLQAEDVAVYYCKQSYSLRTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

```
XENCS541 PD-1 X BTLA (Xtend)
```

**> 9C6_H1.1_L1_[BTLA]_Fab-1C11[PD-1]_H3.240_L3.148_scFv(GKPGS)4-IgG1_pI(-
)_Isosteric_A_/PVA_/S267K/L368D/K370S/M428L/N434S-
Fc(216)_IgG1_C220S/PVA_/S267K/S364K/E357Q/M428L/N434S**

Chain 1 – 9C6_H1.1_ IgG1_pI(-)_Isosteric_A_/PVA_/S267K/L368D/K370S/M428L/N434S (SEQ ID NOS 44464-
44468)
QVQLKESGAEVKKPGASVKVSCKVSGFSLTGYGVNWVRQAPGQGLEWMGMIWIDGSTDYNSKFQGRVTMTKDNSKST
VYMELSSLRSEDTAVYYCARDRPDGRAMDYWGQGTMVTVSS/ASTKGPSVFPLAPSSKSTSGGTAALGCLVKDYFPE
PVTVSWNSGALTSGVHTFPAVLQSSGLYSLSSVVTVPSSSLGTQTYICNVNHKPSDTKVDKKVEPKSCDKTHTCPPC
PAPPVAGPSVFLFPPKPKDTLMISRTPEVTCVVVDVKHEDPEVKFNWYVDGVEVHNAKTKPREEEYNSTYRVVSVLT
VLHQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVLHEALHSHYTQKSLSLSPGK

FIG. 49BB

Chain 2 – 1C11[PD-1]_H3.240_L3.148_scFv(GKPGS)4_Fc(216)_IgG1_C220S/PVA_/S267K/S364K/E357Q/M428L/N434S (SEQ ID NOS 44469-44478 and linker disclosed as SEQ ID NO: 39202)
QVQLVQSGPELKKPGESVKVSCKASGYTFTHYGINWVRQPPGQGLEWMGWINTYTGEPYYAPGFQERFVFSIDTSQD
TAYLQINSLKAEDTAVYYCARDYYGSSPYWGQGTLVTVSS/GKPGSGKPGSGKPGSGKPGS/DVLMTQSPDSLAVSL
GERATINCKSSQSIVHSNGNTYLEWYQQKPGQSPKLLIYKVSNRFSGVPDRFSGSGSGTDFTLTISSLQAEDVAVYY
CFQGSHVPNTFGGGTKVEIK/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VLHEALHSHYTQKSLSLSPGK

Chain 3 – 9C6_L1 (SEQ ID NOS 44479-44483)
SIVMTQSPDSLAVSLGERATINCKASQSVSNDVAWYQQKPGQSPKLLIYYASNRYTGVPDRFTGSGYGTDFTLTISS
LQAEDVAVYFCQQDYSSPTFGGGTKLEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC XENCS542 PD-1 X ICOS (Xtend)

> [ICOS]_H0L0_Fab-1C11[PD-1]_H3.241_L3.148-scFv(GKPGS)4-IgG1_pI(-)_Isosteric_A_/PVA_/S267K/L368D/K370S/M428L/N434S-Fc(216)_IgG1_C220S/PVA_/S267K/S364K/E357Q/M428L/N434S

Chain 1 – [ICOS]_H0_IgG1_pI(-)_Isosteric_A_/PVA_/S267K/L368D/K370S/M428L/N434S (SEQ ID NOS 44484-44488)
QVQLVQSGAEVKKPGASVKVSCKASGYTFTGYYMHWVRQAPGQGLEWMGWINPHSGGTNYAQKFQGRVTMTRDTSIS
TAYMELSRLRSDDTAVYYCARTYYYDSSGYYHDAFDIWGQGTMVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYKCKVSNKALPAPIEKTISK
AKGQPREPQVYTLPPSREEMTKNQVSLTCDVSGFYPSDIAVEWESDGQPENNYKTTPPVLDSDGSFFLYSKLTVDKSRWEQGDVFSCSVLHEA
LHSHYTQKSLSLSPGK

Chain 2 – 1C11[PD-1]_H3.241_L3.148_scFv(GKPGS)4_Fc(216)_IgG1_C220S/PVA_/S267K/S364K/E357Q/M428L/N434S (SEQ ID NOS 44489-44498 and linker disclosed as SEQ ID NO: 39202)
EVQLVQSGPELKKPGESVKVSCKASGYTFTHYGINWVRQPPGQGLEWMGWINTYTGEPYYAPGFQERFVFSIDTSQD
TAYLQINSLKAEDTAVYYCARDYYGSSPYWGQGTLVTVSS/GKPGSGKPGSGKPGSGKPGS/DVLMTQSPDSLAVSL
GERATINCKSSQSIVHSNGNTYLEWYQQKPGQSPKLLIYKVSNRFSGVPDRFSGSGSGTDFTLTISSLQAEDVAVYY
CFQGSHVPNTFGGGTKVEIK/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VLHEALHSHYTQKSLSLSPGK

Chain 3 – [ICOS]_L0 (SEQ ID NOS 44499-44503)
DIQMTQSPSSVSASVGDRVTITCRASQGISRLLAWYQQKPGKAPKLLIYVASSLQSGVPSRFSGSGSGTDFTLTISS
LQPEDFATYYCQQANSFPWTFGQGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

FIG. 49CC

XENCS543 PD-1 X ICOS (Xtend)

> [ICOS]_H0.66_L0_Fab-1C11[PD-1]_H3.241_L3.148-scFv(GKPGS)4-IgG1_pI(-
)_Isosteric_A_/PVA_/S267K/L368D/K370S/M428L/N434S-
Fc(216)_IgG1_C220S/PVA_/S267K/S364K/E357Q/M428L/N434S Chain 1 – [ICOS]_H0.66_ IgG1_pI(-)_Isosteric_A_/PVA_/S267K/L368D/K370S/M428L/N434S (SEQ ID NOS 44504-44508)

QVQLVQSGAEVKKPGASVKVSCKASGYTFTGYYMHWVRQAPGQGLEWMGWINPHSGETIYAQKFQGRVTMTRDTSIS
TAYMELSSLRSEDTAVYYCARTYYYDTSGYYHDAFDVWGQGTMVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSCDK
THTCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPSDI
AVEWESDGQPENNYKTTPPVLDSDGSFFLYSKLTVDKSRWEQGDVFSCSVLHEALHSHYTQKSLSLSPGK

Chain 2 – 1C11[PD-
1]_H3.241_L3.148_scFv(GKPGS)4_Fc(216)_IgG1_C220S/PVA_/S267K/S364K/E357Q/M428L/N434S (SEQ ID NOS 44509-44518 and linker disclosed as SEQ ID NO: 39202)

EVQLVQSGPELKKPGESVKVSCKASGYTFTHYGINWVRQPPGQGLEWMGWINTYTGEPYYAPGFQERFVFSIDTSQD
TAYLQINSLKAEDTAVYYCARDYYGSSPYWGQGTLVTVSS/GKPGSGKPGSGKPGSGKPGS/DVLMTQSPDSLAVSL
GERATINCKSSQSIVHSNGNTYLEWYQQKPGQSPKLLIYKVSNRFSGVPDRFSGSGSGTDFTLTISSLQAEDVAVYY
CFQGSHVPNTFGGGTKVEIK/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VLHEALHSHYTQKSLSLSPGK

Chain 3 – [ICOS]_L0 (SEQ ID NOS 44519-44523)
DIQMTQSPSSVSASVGDRVTITCRASQGISRLLAWYQQKPGKAPKLLIYVASSLQSGVPSRFSGSGSGTDFTLTISS
LQPEDFATYYCQQANSFPWTFGQGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC XENCS544 PD-1 X CTLA-4 (Xtend)

> [CTLA-4]_H3_L0.22_Fab-1C11[PD-1]_H3.241_L3.148_scFv(GKPGS)4-IgG1_pI(-
)_Isosteric_A_/PVA_/S267K/L368D/K370S/M428L/N434S-
Fc(216)_IgG1_C220S/PVA_/S267K/S364K/E357Q/M428L/N434S Chain 1 - [CTLA-4]_H3_ IgG1_pI(-)_Isosteric_A_/PVA_/S267K/L368D/K370S/M428L/N434S (SEQ ID NOS 44524-44528)

EVQLVESGGGLVKPGGSLRLSCAASGFTFSSYTMHWVRQAPGKGLEWVSFISYDGNNKYYADSVKGRFTISRDNAKN
SLYLQMNSLRAEDTAVYYCARTGWLGPFDYWGQGTLVTVSS/ASTKGPSVFPLAPSSKSTSGGTAALGCLVKDYFPE
PVTVSWNSGALTSGVHTFPAVLQSSGLYSLSSVVTVPSSSLGTQTYICNVNHKPSDTKVDKKVEPKSCDKTHTCPPC
PAPPVAGPSVFLFPPKPKDTLMISRTPEVTCVVVDVKHEDPEVKFNWYVDGVEVHNAKTKPREEEYNSTYRVVSVLT
VLHQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVLHEALHSHYTQKSLSLSPGK

FIG. 49DD

Chain 2 - 1C11[PD-1]_H3.241_L3.148_scFv(GKPGS)4_Fc(216)_IgG1_C220S/PVA_/S267K/S364K/E357Q/M428L/N434S
(SEQ ID NOS 44529-44538 and linker disclosed as SEQ ID NO: 39202)
EVQLVQSGPELKKPGESVKVSCKASGYTFTHYGINWVRQPPGQGLEWMGWINTYTGEPYYAPGFQERFVFSIDTSQDTAYLQ
INSLKAEDTAVYYCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK/EPKSSDKTHTCPPCPAPPVAGPSVFLFPPKPKDTLMISRTPEVTCVVVDVKHEDPEVKFNWYVDGVEVHNAKTKPR
EEQYNSTYRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVLHEALHSHYTQKSLSLSPGK

Chain 3 - [CTLA-4]_L0.22 (SEQ ID NOS 44539-44543)
EIVLTQSPGTLSLSPGERATLSCRASQSVSSSYLAWYQQKPGQAPRLLIYGAFSRATGIPDRFSGSGSGTDFTLTISRLEPE
DFAVYYCQQYGSSPWTFGQGTKVEIK/RTVAAPSVFIFPPSDEQLKSGTASVVCLLNNFYPREAKVQWKVDNALQSGNSQES
VTEQDSKDSTYSLSSTLTLSKADYEKHKVYACEVTHQGLSSPVTKSFNRGEC XENCS545 PD-1 X LAG-3 (Xtend)

> 7G8_H3.30_L1.34_[LAG-3]_Fab-1C11[PD-1]_H3.241_L3.148_scFv(GKPGS)4-IgG1_pI(-)_Isosteric_A_/PVA_/S267K/L368D/K370S/M428L/N434S-Fc(216)_IgG1_C220S/PVA_/S267K/S364K/E357Q/M428L/N434S

Chain 1 – 7G8_H3.30_ IgG1_pI(-)_Isosteric_A_/PVA_/S267K/L368D/K370S/M428L/N434S (SEQ ID NOS 44544-44548)
EVQLVESGGGLVQPGGSLRLSCAASGFTFDDAWMSWVRQAPGKGLEWVAEISTKANNHATYYAESVKGRFTISRDDSKSSVY
LQMNSLRAEDTAVYYCTRLATWDWYFDVWGQGTTVTVSS/ASTKGPSVFPLAPSSKSTSGGTAALGCLVKDYFPEPVTVSWN
SGALTSGVHTFPAVLQSSGLYSLSSVVTVPSSSLGTQTYICNVNHKPSDTKVDKKVEPKSCDKTHTCPPCPAPPVAGPSVFL
FPPKPKDTLMISRTPEVTCVVVDVKHEDPEVKFNWYVDGVEVHNAKTKPREEEYNSTYRVVSVLTVLHQDWLNGKEYKCKVS
NKALPAPIEKTISKAKGQPREPQVYTLPPSREEMTKNQVSLTCDVSGFYPSDIAVEWESDGQPENNYKTTPPVLDSDGSFFL
YSKLTVDKSRWEQGDVFSCSVLHEALHSHYTQKSLSLSPGK

Chain 2 –1C11[PD-1]_H3.241_L3.148_scFv(GKPGS)4_Fc(216)_IgG1_C220S/PVA_/S267K/S364K/E357Q/M428L/N434S
(SEQ ID NOS 44549-44558 and linker disclosed as SEQ ID NO: 39202)
EVQLVQSGPELKKPGESVKVSCKASGYTFTHYGINWVRQPPGQGLEWMGWINTYTGEPYYAPGFQERFVFSIDTSQDTAYLQ
INSLKAEDTAVYYCARDYYGSSPYWGQGTLVTVSS/GKPGSGKPGSGKPGSGKPGS/DVLMTQSPDSLAVSLGERATINCKS
SQSIVHSNGNTYLEWYQQKPGQSPKLLIYKVSNRFSGVPDRFSGSGSGTDFTLTISSLQAEDVAVYYCFQGSHVPNTFGGGT
KVEIK/EPKSSDKTHTCPPCPAPPVAGPSVFLFPPKPKDTLMISRTPEVTCVVVDVKHEDPEVKFNWYVDGVEVHNAKTKPR
EEQYNSTYRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVLHEALHSHYTQKSLSLSPGK

Chain 3 – 7G8_L1.34 (SEQ ID NOS 44559-44563)
DIVLTQSPSSLSASVGDRVTITCRASQSVDYDGDSYMNWYQQKPGKPPKLLIYAASELESGIPARFSGSGSGTDFTLTISSL
QPEDFATYYCQQSNEDPFTFGSGTKLEIK/RTVAAPSVFIFPPSDEQLKSGTASVVCLLNNFYPREAKVQWKVDNALQSGNS
QESVTEQDSKDSTYSLSSTLTLSKADYEKHKVYACEVTHQGLSSPVTKSFNRGEC

FIG. 49EE

XENCS546 PD-1 X LAG-3 (Xtend)

> 2A11_H1.144_L2.142_[LAG-3]_Fab-1C11[PD-1]_H3.241_L3.148_scFv(GKPGS)4-IgG1_pI(-)_Isosteric_A_/PVA_/S267K/L368D/K370S/M428L/N434S-Fc(216)_IgG1_C220S/PVA_/S267K/S364K/E357Q/M428L/N434S

Chain 1 – 2A11_H1.144_ IgG1_pI(-)_Isosteric_A_/PVA_/S267K/L368D/K370S/M428L/N434S (SEQ ID NOS 44564-44568)
EVQLVQSGAEVKKPGATVKISCKASGFNIKDYFMHWVQQAPGKGLEWMGWIDPELGDTEYAPKFQGRVTITADTSTN
TAYMELSSLRSEDTAVYYCYARGVYQALDYWGQGTLVTVSS/ASTKGPSVFPLAPSSKSTSGGTAALGCLVKDYFPE
PVTVSWNSGALTSGVHTFPAVLQSSGLYSLSSVVTVPSSSLGTQTYICNVNHKPSDTKVDKKVEPKSCDKTHTCPPC
PAPPVAGPSVFLFPPKPKDTLMISRTPEVTCVVVDVKHEDPEVKFNWYVDGVEVHNAKTKPREEEYNSTYRVVSVLT
VLHQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVLHEALHSHYTQKSLSLSPGK

Chain 2 – 1C11[PD-1]_H3.241_L3.148_scFv(GKPGS)4_Fc(216)_IgG1_C220S/PVA_/S267K/S364K/E357Q/M428L/N434S (SEQ ID NOS 44569-44578 and linker disclosed as SEQ ID NO: 39202)
EVQLVQSGPELKKPGESVKVSCKASGYTFTHYGINWVRQPPGQGLEWMGWINTYTGEPYYAPGFQERFVFSIDTSQD
TAYLQINSLKAEDTAVYYCARDYYGSSPYWGQGTLVTVSS/GKPGSGKPGSGKPGSGKPGS/DVLMTQSPDSLAVSL
GERATINCKSSQSIVHSNGNTYLEWYQQKPGQSPKLLIYKVSNRFSGVPDRFSGSGSGTDFTLTISSLQAEDVAVYY
CFQGSHVPNTFGGGTKVEIK/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VLHEALHSHYTQKSLSLSPGK

Chain 3 – 2A11_L2.142 (SEQ ID NOS 44579-44583)
DIQMTQSPAFLSVTPGEKVTITCQASQDIGNYLNWFQQKPGQTVKLLIYFTSYLHSGVPSRFSGSGSGTDYTFTISS
LEAEDAATYFCQQGNTLPYTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC XENCS547 PD-1 X TIM-3 (Xtend)

> 3H3_H1_L2.1_Fab-1C11[PD-1]_H3.241_L3.148-scFv(GKPGS)4-IgG1_pI(-)_Isosteric_A_/PVA_/S267K/L368D/K370S/M428L/N434S-Fc(216)_IgG1_C220S/PVA_/S267K/S364K/E357Q/M428L/N434S

Chain 1 – 3H3_H1_ IgG1_pI(-)_Isosteric_A_/PVA_/S267K/L368D/K370S/M428L/N434S (SEQ ID NOS 44584-44588)
QVTLKESGPVLVKPTETLTLTCTVSGFSLNGYGVNWVRQPPGKGLEWLAMIWGDGSTDYNSALKSRLTISKDNSKSQ
VVLTMTNMDPVDTATYYCARSYYTSDEDYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSDTKVDKKVEPKSCDKTHTCPPCP
APPVAGPSVFLFPPKPKDTLMISRTPEVTCVVVDVKHEDPEVKFNWYVDGVEVHNAKTKPREEEYNSTYRVVSVLTV
LHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVLHEALHSHYTQKSLSLSPGK

FIG. 49FF

Chain 2 – 1C11[PD-1]_H3.241_L3.148_scFv(GKPGS)4_Fc(216)_IgG1_C220S/PVA_/S267K/S364K/E357Q/M428L/N434S (SEQ ID NOS 44589-44598 and linker disclosed as SEQ ID NO: 39202)
EVQLVQSGPELKKPGESVKVSCKASGYTFT<u>HYGIN</u>WVRQPPGQGLEWMG<u>WINTYTGEPYYAPGFQER</u>FVFSIDTSQD
TAYLQINSLKAEDTAVYYCARD<u>YYGSSPY</u>WGQGTLVTVSS/<u>GKPGSGKPGSGKPGSGKPGS</u>/DVLMTQSPDSLAVSL
GERATINCK<u>SSQSIVHSNGNTYLE</u>WYQQKPGQSPKLLIY<u>KVSNRFS</u>GVPDRFSGSGSGTDFTLTISSLQAEDVAVYY
C<u>FQGSHVPNT</u>FGGGTKVEIK/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VLHEALHSHYTQKSLSLSPGK

Chain 3 – 3H3_L2.1 (SEQ ID NOS 44599-44603)
DIVMTQSPDSLAVSLGERATINCK<u>SSQSLLNSRTRKNYLA</u>WYQQKPGQSPKLLIY<u>WASTRES</u>GVPDRFTGSGSGTDF
TLTISSLQAEDVAVYYC<u>KQSYSLRT</u>FGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC XENCS548 PD-1 X BTLA (Xtend)

> 9C6_H1.1_L1_[BTLA]_Fab-1C11[PD-1]_H3.241_L3.148_scFv(GKPGS)4-IgG1_pI(-)_Isosteric_A_/PVA_/S267K/L368D/K370S/M428L/N434S-Fc(216)_IgG1_C220S/PVA_/S267K/S364K/E357Q/M428L/N434S

Chain 1 – 9C6_H1.1_IgG1_pI(-)_Isosteric_A_/PVA_/S267K/L368D/K370S/M428L/N434S (SEQ ID NOS 44604-44608)
QVQLKESGAEVKKPGASVKVSCKVSGFSLT<u>GYGVN</u>WVRQAPGQGLEWMG<u>MIWIDGSTDYNSKFQG</u>RVTMTKDNSKST
VYMELSSLRSEDTAVYYCARD<u>RPDGRAMDY</u>WGQGTMVTVSS/ASTKGPSVFPLAPSSKSTSGGTAALGCLVKDYFPE
PVTVSWNSGALTSGVHTFPAVLQSSGLYSLSSVVTVPSSSLGTQTYICNVNHKPSDTKVDKKVEPKSCDKTHTCPPC
PAPPVAGPSVFLFPPKPKDTLMISRTPEVTCVVVDVKHEDPEVKFNWYVDGVEVHNAKTKPREEEYNSTYRVVSVLT
VLHQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVLHEALHSHYTQKSLSLSPGK

Chain 2 – 1C11[PD-1]_H3.241_L3.148_scFv(GKPGS)4_Fc(216)_IgG1_C220S/PVA_/S267K/S364K/E357Q/M428L/N434S (SEQ ID NOS 44609-44618 and linker disclosed as SEQ ID NO: 39202)
EVQLVQSGPELKKPGESVKVSCKASGYTFT<u>HYGIN</u>WVRQPPGQGLEWMG<u>WINTYTGEPYYAPGFQER</u>FVFSIDTSQD
TAYLQINSLKAEDTAVYYCARD<u>YYGSSPY</u>WGQGTLVTVSS/<u>GKPGSGKPGSGKPGSGKPGS</u>/DVLMTQSPDSLAVSL
GERATINCK<u>SSQSIVHSNGNTYLE</u>WYQQKPGQSPKLLIY<u>KVSNRFS</u>GVPDRFSGSGSGTDFTLTISSLQAEDVAVYY
C<u>FQGSHVPNT</u>FGGGTKVEIK/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VLHEALHSHYTQKSLSLSPGK

Chain 3 – 9C6_L1 (SEQ ID NOS 44619-44623)
SIVMTQSPDSLAVSLGERATINCK<u>ASQSVSNDVA</u>WYQQKPGQSPKLLIY<u>YASNRYT</u>GVPDRFTGSGYGTDFTLTISS
LQAEDVAVYFC<u>QQDYSSPT</u>FGGGTKLEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

FIG. 49GG

```
XENCS549 PD-1 X ICOS (Xtend)
```

> [ICOS]_H0L0_Fab-1C11[PD-1]_H3.241_L3.92-scFv(GKPGS)4-IgG1_pI(-
)_Isosteric_A_/PVA_/S267K/L368D/K370S/M428L/N434S-
Fc(216)_IgG1_C220S/PVA_/S267K/S364K/E357Q/M428L/N434S

Chain 1 – [ICOS]_H0_ IgG1_pI(-)_Isosteric_A_/PVA_/S267K/L368D/K370S/M428L/N434S (SEQ ID NOS 44624-44628)

QVQLVQSGAEVKKPGASVKVSCKASGYTFTGYYMHWVRQAPGQGLEWMGWINPHSGGTNYAQKFQGRVTMTRDTSIS
TAYMELSRLRSDDTAVYYCARTYYYDSSGYYHDAFDIWGQGTMVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYKCKVSNKALPAPIEKTISK
AKGQPREPQVYTLPPSREEMTKNQVSLTCDVSGFYPSDIAVEWESDGQPENNYKTTPPVLDSDGSFFLYSKLTVDKSRWEQGDVFSCSVLHEA
LHSHYTQKSLSLSPGK

Chain 2 – 1C11[PD-1]_H3.241_L3.92_scFv(GKPGS)4_Fc(216)_IgG1_C220S/PVA_/S267K/S364K/E357Q/M428L/N434S (SEQ ID NOS 44629-44638 and linker disclosed as SEQ ID NO: 39202)

EVQLVQSGPELKKPGESVKVSCKASGYTFTHYGINWVRQPPGQGLEWMGWINTYTGEPYYAPGFQERFVFSIDTSQD
TAYLQINSLKAEDTAVYYCARDYYGSSPYWGQGTLVTVSS/GKPGSGKPGSGKPGSGKPGS/DIVMTQSPDSLAVSL
GERVTINCKASQSIVHSNGNTYLEWYQQKPGQPPKLLIYKVSNRFTGVPDRFSGSGSGTDFTLTISSLQAEDVAVYY
CFQGSHVPNTFGGGTKVEIK/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VLHEALHSHYTQKSLSLSPGK

Chain 3 – [ICOS]_L0 (SEQ ID NOS 44639-44643)

DIQMTQSPSSVSASVGDRVTITCRASQGISRLLAWYQQKPGKAPKLLIYVASSLQSGVPSRFSGSGSGTDFTLTISS
LQPEDFATYYCQQANSFPWTFGQGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

```
XENCS550 PD-1 X ICOS (Xtend)
```

> [ICOS]_H0.66_L0_Fab-1C11[PD-1]_H3.241_L3.92-scFv(GKPGS)4-IgG1_pI(-
)_Isosteric_A_/PVA_/S267K/L368D/K370S/M428L/N434S-
Fc(216)_IgG1_C220S/PVA_/S267K/S364K/E357Q/M428L/N434S

Chain 1 – [ICOS]_H0.66_ IgG1_pI(-)_Isosteric_A_/PVA_/S267K/L368D/K370S/M428L/N434S (SEQ ID NOS 44644-44648)

QVQLVQSGAEVKKPGASVKVSCKASGYTFTGYYMHWVRQAPGQGLEWMGWINPHSGETIYAQKFQGRVTMTRDTSIS
TAYMELSSLRSEDTAVYYCARTYYYDTSGYYHDAFDVWGQGTMVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSCDK
THTCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPSDI
AVEWESDGQPENNYKTTPPVLDSDGSFFLYSKLTVDKSRWEQGDVFSCSVLHEALHSHYTQKSLSLSPGK

FIG. 49HH

Chain 2 – 1C11[PD-1]_H3.241_L3.92_scFv(GKPGS)4_Fc(216)_IgG1_C220S/PVA_/S267K/S364K/E357Q/M428L/N434S (SEQ ID NOS 44649-44658 and linker disclosed as SEQ ID NO: 39202)
EVQLVQSGPELKKPGESVKVSCKASGYTFTHYGINWVRQPPGQGLEWMGWINTYTGEPYYAPGFQERFVFSIDTSQD
TAYLQINSLKAEDTAVYYCARDYYGSSPYWGQGTLVTVSS/GKPGSGKPGSGKPGSGKPGS/DIVMTQSPDSLAVSL
GERVTINCKASQSIVHSNGNTYLEWYQQKPGQPPKLLIYKVSNRFTGVPDRFSGSGSGTDFTLTISSLQAEDVAVYY
CFQGSHVPNTFGGGTKVEIK/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VLHEALHSHYTQKSLSLSPGK

Chain 3 – [ICOS]_L0 (SEQ ID NOS 44659-44663)
DIQMTQSPSSVSASVGDRVTITCRASQGISRLLAWYQQKPGKAPKLLIYVASSLQSGVPSRFSGSGSGTDFTLTISS
LQPEDFATYYCQQANSFPWTFGQGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC XENCS551 PD-1 X CTLA-4 (Xtend)

>[CTLA-4]_H3_L0.22_Fab-1C11[PD-1]_H3.241_L3.92_scFv(GKPGS)4-IgG1_pI(-)_Isosteric_A_/PVA_/S267K/L368D/K370S/M428L/N434S-Fc(216)_IgG1_C220S/PVA_/S267K/S364K/E357Q/M428L/N434S

Fab Chain 1 - [CTLA-4]_H3_IgG1_pI(-)_Isosteric_A_/PVA_/S267K/L368D/K370S/M428L/N434S (SEQ ID NOS 44664-44668)
EVQLVESGGGLVKPGGSLRLSCAASGFTFSSYTMHWVRQAPGKGLEWVSFISYDGNNKYYADSVKGRFTISRDNAKN
SLYLQMNSLRAEDTAVYYCARTGWLGPFDYWGQGTLVTVSS/ASTKGPSVFPLAPSSKSTSGGTAALGCLVKDYFPE
PVTVSWNSGALTSGVHTFPAVLQSSGLYSLSSVVTVPSSSLGTQTYICNVNHKPSDTKVDKKVEPKSCDKTHTCPPC
PAPPVAGPSVFLFPPKPKDTLMISRTPEVTCVVVDVKHEDPEVKFNWYVDGVEVHNAKTKPREEEYNSTYRVVSVLT
VLHQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVLHEALHSHYTQKSLSLSPGK scFv Chain 2 - 1C11[PD-1]_H3.241_L3.92_scFv(GKPGS)4_Fc(216)_IgG1_C220S/PVA_/S267K/S364K/E357Q/M428L/N434S (SEQ ID NOS 44669-44678 and linker disclosed as SEQ ID NO: 39202)
EVQLVQSGPELKKPGESVKVSCKASGYTFTHYGINWVRQPPGQGLEWMGWINTYTGEPYYAPGFQERFVFSIDTSQD
TAYLQINSLKAEDTAVYYCARDYYGSSPYWGQGTLVTVSS/GKPGSGKPGSGKPGSGKPGS/DIVMTQSPDSLAVSL
GERVTINCKASQSIVHSNGNTYLEWYQQKPGQPPKLLIYKVSNRFTGVPDRFSGSGSGTDFTLTISSLQAEDVAVYY
CFQGSHVPNTFGGGTKVEIK/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VLHEALHSHYTQKSLSLSPGK

Light Chain 3 - [CTLA-4]_L0.22 (SEQ ID NOS 44679-44683)
EIVLTQSPGTLSLSPGERATLSCRASQSVSSSYLAWYQQKPGQAPRLLIYGAFSRATGIPDRFSGSGSGTDFTLTIS
RLEPEDFAVYYCQQYGSSPWTFGQGTKVEIK/RTVAAPSVFIFPPSDEQLKSGTASVVCLLNNFYPREAKVQWKVDNALQ
SGNSQESVTEQDSKDSTYSLSSTLTLSKADYEKHKVYACEVTHQGLSSPVTKSFNRGEC

FIG. 49II

XENCS552 PD-1 X LAG-3 (Xtend)

> 7G8_H3.30_L1.34_[LAG-3]_Fab-1C11[PD-1]_H3.241_L3.92_scFv(GKPGS)4-IgG1_pI(-
)_Isosteric_A_/PVA_/S267K/L368D/K370S/M428L/N434S-
Fc(216)_IgG1_C220S/PVA_/S267K/S364K/E357Q/M428L/N434S

Chain 1 – 7G8_H3.30_ IgG1_pI(-)_Isosteric_A_/PVA_/S267K/L368D/K370S/M428L/N434S (SEQ ID NOS 44684-44688)
EVQLVESGGGLVQPGGSLRLSCAASGFTFDDAWMSWVRQAPGKGLEWVAEISTKANNHATYYAESVKGRFTISRDDSKSSVY
LQMNSLRAEDTAVYYCTRLATWDWYFDVWGQGTTVTVSS/ASTKGPSVFPLAPSSKSTSGGTAALGCLVKDYFPEPVTVSWN
SGALTSGVHTFPAVLQSSGLYSLSSVVTVPSSSLGTQTYICNVNHKPSDTKVDKKVEPKSCDKTHTCPPCPAPPVAGPSVFL
FPPKPKDTLMISRTPEVTCVVVDVKHEDPEVKFNWYVDGVEVHNAKTKPREEEYNSTYRVVSVLTVLHQDWLNGKEYKCKVS
NKALPAPIEKTISKAKGQPREPQVYTLPPSREEMTKNQVSLTCDVSGFYPSDIAVEWESDGQPENNYKTTPPVLDSDGSFFL
YSKLTVDKSRWEQGDVFSCSVLHEALHSHYTQKSLSLSPGK

Chain 2 –1C11[PD-1]_H3.241_L3.92_scFv(GKPGS)4_Fc(216)_IgG1_C220S/PVA_/S267K/S364K/E357Q/M428L/N434S
(SEQ ID NOS 44689-44698 and linker disclosed as SEQ ID NO: 39202)
EVQLVQSGPELKKPGESVKVSCKASGYTFTHYGINWVRQPPGQGLEWMGWINTYTGEPYYAPGFQERFVFSIDTSQDTAYLQ
INSLKAEDTAVYYCARDYYGSSPYWGQGTLVTVSS/GKPGSGKPGSGKPGSGKPGS/DIVMTQSPDSLAVSLGERVTINCKA
SQSIVHSNGNTYLEWYQQKPGQPPKLLIYKVSNRFTGVPDRFSGSGSGTDFTLTISSLQAEDVAVYYCFQGSHVPNTFGGGT
KVEIK/EPKSSDKTHTCPPCPAPPVAGPSVFLFPPKPKDTLMISRTPEVTCVVVDVKHEDPEVKFNWYVDGVEVHNAKTKPR
EEQYNSTYRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVLHEALHSHYTQKSLSLSPGK

Chain 3 – 7G8_L1.34 (SEQ ID NOS 44699-44703)
DIVLTQSPSSLSASVGDRVTITCRASQSVDYDGDSYMNWYQQKPGKPPKLLIYAASELESGIPARFSGSGSGTDFTLTISSL
QPEDFATYYCQQSNEDPFTFGSGTKLEIK/RTVAAPSVFIFPPSDEQLKSGTASVVCLLNNFYPREAKVQWKVDNALQSGNS
QESVTEQDSKDSTYSLSSTLTLSKADYEKHKVYACEVTHQGLSSPVTKSFNRGEC XENCS553 PD-1 X LAG-3 (Xtend)

> 2A11_H1.144_L2.142_[LAG-3]_Fab-1C11[PD-1]_H3.241_L3.92_scFv(GKPGS)4-IgG1_pI(-
)_Isosteric_A_/PVA_/S267K/L368D/K370S/M428L/N434S-
Fc(216)_IgG1_C220S/PVA_/S267K/S364K/E357Q/M428L/N434S

Chain 1 – 2A11_H1.144_ IgG1_pI(-)_Isosteric_A_/PVA_/S267K/L368D/K370S/M428L/N434S (SEQ ID NOS 44704-44708)
EVQLVQSGAEVKKPGATVKISCKASGFNIKDYFMHWVQQAPGKGLEWMGWIDPELGDTEYAPKFQGRVTITADTSTNTAYME
LSSLRSEDTAVYYCYARGVYQALDYWGQGTLVTVSS/ASTKGPSVFPLAPSSKSTSGGTAALGCLVKDYFPEPVTVSWNSGA
LTSGVHTFPAVLQSSGLYSLSSVVTVPSSSLGTQTYICNVNHKPSDTKVDKKVEPKSCDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYKCKVSNKA
LPAPIEKTISKAKGQPREPQVYTLPPSREEMTKNQVSLTCDVSGFYPSDIAVEWESDGQPENNYKTTPPVLDSDGSFFLYSK
LTVDKSRWEQGDVFSCSVLHEALHSHYTQKSLSLSPGK

FIG. 49JJ

Chain 2 – 1C11[PD-1]_H3.241_L3.92_scFv(GKPGS)4_Fc(216)_IgG1_C220S/PVA_/S267K/S364K/E357Q/M428L/N434S
(SEQ ID NOS 44709-44718 and linker disclosed as SEQ ID NO: 39202)
EVQLVQSGPELKKPGESVKVSCKASGYTFTHYGINWVRQPPGQGLEWMGWINTYTGEPYYAPGFQERFVFSIDTSQDTAYLQ
INSLKAEDTAVYYCARDYYGSSPYWGQGTLVTVSS/GKPGSGKPGSGKPGSGKPGS/DIVMTQSPDSLAVSLGERVTINCKA
SQSIVHSNGNTYLEWYQQKPGQPPKLLIYKVSNRFTGVPDRFSGSGSGTDFTLTISSLQAEDVAVYYCFQGSHVPNTFGGGT
KVEIK/EPKSSDKTHTCPPCPAPPVAGPSVFLFPPKPKDTLMISRTPEVTCVVVDVKHEDPEVKFNWYVDGVEVHNAKTKPR
EEQYNSTYRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVLHEALHSHYTQKSLSLSPGK

Chain 3 – 2A11_L2.142 (SEQ ID NOS 44719-44723)
DIQMTQSPAFLSVTPGEKVTITCQASQDIGNYLNWFQQKPGQTVKLLIYFTSYLHSGVPSRFSGSGSGTDYTFTISSLEAED
AATYFCQQGNTLPYTFGGGTKVEIK/RTVAAPSVFIFPPSDEQLKSGTASVVCLLNNFYPREAKVQWKVDNALQSGNSQESV
TEQDSKDSTYSLSSTLTLSKADYEKHKVYACEVTHQGLSSPVTKSFNRGEC XENCS554 PD-1 X TIM-3 (Xtend)

> 3H3_H1_L2.1_Fab-1C11[PD-1]_H3.241_L3.92-scFv(GKPGS)4-IgG1_pI(-
)_Isosteric_A_/PVA_/S267K/L368D/K370S/M428L/N434S-
Fc(216)_IgG1_C220S/PVA_/S267K/S364K/E357Q/M428L/N434S

Chain 1 – 3H3_H1_ IgG1_pI(-)_Isosteric_A_/PVA_/S267K/L368D/K370S/M428L/N434S (SEQ ID NOS 44724-44728)
QVTLKESGPVLVKPTETLTLTCTVSGFSLNGYGVNWVRQPPGKGLEWLAMIWGDGSTDYNSALKSRLTISKDNSKSQVVLTM
TNMDPVDTATYYCARSYYTSDEDYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSDTKVDKKVEPKSCDKTHTCPPCPAPPVAGPSVFLFPPK
PKDTLMISRTPEVTCVVVDVKHEDPEVKFNWYVDGVEVHNAKTKPREEEYNSTYRVVSVLTVLHQDWLNGKEYKCKVSNKAL
PAPIEKTISKAKGQPREPQVYTLPPSREEMTKNQVSLTCDVSGFYPSDIAVEWESDGQPENNYKTTPPVLDSDGSFFLYSKL
TVDKSRWEQGDVFSCSVLHEALHSHYTQKSLSLSPGK

Chain 2 – 1C11[PD-1]_H3.241_L3.92_scFv(GKPGS)4_Fc(216)_IgG1_C220S/PVA_/S267K/S364K/E357Q/M428L/N434S
(SEQ ID NOS 44729-44738 and linker disclosed as SEQ ID NO: 39202)
EVQLVQSGPELKKPGESVKVSCKASGYTFTHYGINWVRQPPGQGLEWMGWINTYTGEPYYAPGFQERFVFSIDTSQDTAYLQ
INSLKAEDTAVYYCARDYYGSSPYWGQGTLVTVSS/GKPGSGKPGSGKPGSGKPGS/DIVMTQSPDSLAVSLGERVTINCKA
SQSIVHSNGNTYLEWYQQKPGQPPKLLIYKVSNRFTGVPDRFSGSGSGTDFTLTISSLQAEDVAVYYCFQGSHVPNTFGGGT
KVEIK/EPKSSDKTHTCPPCPAPPVAGPSVFLFPPKPKDTLMISRTPEVTCVVVDVKHEDPEVKFNWYVDGVEVHNAKTKPR
EEQYNSTYRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVLHEALHSHYTQKSLSLSPGK

Chain 3 – 3H3_L2.1 (SEQ ID NOS 44739-44743)
DIVMTQSPDSLAVSLGERATINCKSSQSLLNSRTRKNYLAWYQQKPGQSPKLLIYWASTRESGVPDRFTGSGSGTDFTLTIS
SLQAEDVAVYYCKQSYSLRTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

FIG. 49KK

XENCS555 PD-1 X BTLA (Xtend)

**> 9C6_H1.1_L1_[BTLA]_Fab-1C11[PD-1]_H3.241_L3.92_scFv(GKPGS)4-IgG1_pI(-
)_Isosteric_A_/PVA_/S267K/L368D/K370S/M428L/N434S-
Fc(216)_IgG1_C220S/PVA_/S267K/S364K/E357Q/M428L/N434S**

Chain 1 – 9C6_H1.1_ IgG1_pI(-)_Isosteric_A_/PVA_/S267K/L368D/K370S/M428L/N434S (SEQ ID NOS 44744-44748)
QVQLKESGAEVKKPGASVKVSCKVSGFSLTGYGVNWVRQAPGQGLEWMGMIWIDGSTDYNSKFQGRVTMTKDNSKST
VYMELSSLRSEDTAVYYCARDRPDGRAMDYWGQGTMVTVSS/ASTKGPSVFPLAPSSKSTSGGTAALGCLVKDYFPE
PVTVSWNSGALTSGVHTFPAVLQSSGLYSLSSVVTVPSSSLGTQTYICNVNHKPSDTKVDKKVEPKSCDKTHTCPPC
PAPPVAGPSVFLFPPKPKDTLMISRTPEVTCVVVDVKHEDPEVKFNWYVDGVEVHNAKTKPREEEYNSTYRVVSVLT
VLHQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVLHEALHSHYTQKSLSLSPGK

**Chain 2 – 1C11[PD-
1]_H3.241_L3.92_scFv(GKPGS)4_Fc(216)_IgG1_C220S/PVA_/S267K/S364K/E357Q/M428L/N434S** (SEQ ID NOS
44749-44758 and linker disclosed as SEQ ID NO: 39202)
EVQLVQSGPELKKPGESVKVSCKASGYTFTHYGINWVRQPPGQGLEWMGWINTYTGEPYYAPGFQERFVFSIDTSQD
TAYLQINSLKAEDTAVYYCARDYYGSSPYWGQGTLVTVSS/GKPGSGKPGSGKPGSGKPGS/DIVMTQSPDSLAVSL
GERVTINCKASQSIVHSNGNTYLEWYQQKPGQPPKLLIYKVSNRFTGVPDRFSGSGSGTDFTLTISSLQAEDVAVYY
CFQGSHVPNTFGGGTKVEIK/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VLHEALHSHYTQKSLSLSPGK

Chain 3 – 9C6_L1 (SEQ ID NOS 44759-44763)
SIVMTQSPDSLAVSLGERATINCKASQSVSNDVAWYQQKPGQSPKLLIYYASNRYTGVPDRFTGSGYGTDFTLTISS
LQAEDVAVYFCQQDYSSPTFGGGTKLEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

FIG. 50A

XENCS:556 (BO skeleton 1)

> [αXXX]_HXLX_Fab-1C11[PD-1]_H3.234_L3.144_scFv(GKPGS)4-IgG1_pI(-
)_Isosteric_A_/PVA_/S267K/L368D/K370S-Fc(216)_IgG1_C220S/PVA_/S267K/S364K/E357Q

Fab Chain 1 – [αXXX]_HX_IgG1_pI(-)_Isosteric_A_/PVA_/S267K/L368D/K370S (SEQ ID NO: 44764)
/ASTKGPSVFPLAPSSKSTSGGTAALGCLVKDYFPEPVTVSWNSGALTSGVHTFPAVLQSSGLYSLSSVVTVPSSSL
GTQTYICNVNHKPSDTKVDKKVEPKSCDKTHTCPPCPAPPVAGPSVFLFPPKPKDTLMISRTPEVTCVVVDVKHEDP
EVKFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVFSC
SVMHEALHNHYTQKSLSLSPGK scFv Chain 2 – 1C11[PD-1]_H3.234_L3.144_scFv(GKPGS)4_Fc(216)_IgG1_C220S/PVA_/S267K/S364K/E357Q (SEQ
ID NOS 44765-44774 and linker disclosed as SEQ ID NO: 39202)
EVQLVQSGSELKKPGESVKVSCKASGYTFTHYGINWVRQPPGQGLEWMGWINTYTGEPYYAPGFQERFVFSLDTSQD
TAYLQINSLKAEDTAVYYCARDYYGSSPYWGQGTLVTVSS/GKPGSGKPGSGKPGSGKPGS/DIVMTQSPDSLAVSL
GERVTINCKASQSIVHSNGNTYLEWYQQKPGQPPKLLIYKVSNRFSGVPDRFSGSGSGTDFTLTISSVEAEDAATYY
CFQGSHVPNTFGQGTKVEIK/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VMHEALHNHYTQKSLSLSPGK

Light Chain 3 – [αXXX]_LX (SEQ ID NO: 44775)
/RTVAAPSVFIFPPSDEQLKSGTASVVCLLNNFYPREAKVQWKVDNALQSGNSQESVTEQDSKDSTYSLSSTLTLSK
ADYEKHKVYACEVTHQGLSSPVTKSFNRGEC XENCS557 (BO skeleton 2)

> [αXXX]_HXLX_Fab-1C11[PD-1]_H3.240_L3.148_scFv(GKPGS)4-IgG1_pI(-
)_Isosteric_A_/PVA_/S267K/L368D/K370S-Fc(216)_IgG1_C220S/PVA_/S267K/S364K/E357Q

Fab Chain 1 – [αXXX]_HX_ IgG1_pI(-)_Isosteric_A_/PVA_/S267K/L368D/K370S (SEQ ID NO: 44776)
/ASTKGPSVFPLAPSSKSTSGGTAALGCLVKDYFPEPVTVSWNSGALTSGVHTFPAVLQSSGLYSLSSVVTVPSSSL
GTQTYICNVNHKPSDTKVDKKVEPKSCDKTHTCPPCPAPPVAGPSVFLFPPKPKDTLMISRTPEVTCVVVDVKHEDP
EVKFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVFSC
SVMHEALHNHYTQKSLSLSPGK

FIG. 50B scFv Chain 2 – 1C11[PD-1]_H3.240_L3.148_scFv(GKPGS)4_Fc(216)_IgG1_C220S/PVA_/S267K/S364K/E357Q (SEQ ID NOS 44777-44786 and linker disclosed as SEQ ID NO: 39202)
QVQLVQSGPELKKPGESVKVSCKASGYTFTHYGINWVRQPPGQGLEWMGWINTYTGEPYYAPGFQERFVFSIDTSQD
TAYLQINSLKAEDTAVYYCARDYYGSSPYWGQGTLVTVSS/GKPGSGKPGSGKPGSGKPGS/DVLMTQSPDSLAVSL
GERATINCKSSQSIVHSNGNTYLEWYQQKPGQSPKLLIYKVSNRFSGVPDRFSGSGSGTDFTLTISSLQAEDVAVYY
CFQGSHVPNTFGGGTKVEIK/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VMHEALHNHYTQKSLSLSPGK

Light Chain 3 – [αXXX]_LX (SEQ ID NO: 44787)
/RTVAAPSVFIFPPSDEQLKSGTASVVCLLNNFYPREAKVQWKVDNALQSGNSQESVTEQDSKDSTYSLSSTLTLSK
ADYEKHKVYACEVTHQGLSSPVTKSFNRGEC XENCS558 (BO skeleton 3)

> [αXXX]_HXLX_Fab-1C11[PD-1]_H3.241_L3.148_scFv(GKPGS)4-IgG1_pI(-)_Isosteric_A_/PVA_/S267K/L368D/K370S-Fc(216)_IgG1_C220S/PVA_/S267K/S364K/E357Q

Fab Chain 1 – [αXXX]_HX_IgG1_pI(-)_Isosteric_A_/PVA_/S267K/L368D/K370S (SEQ ID NO: 44788)
/ASTKGPSVFPLAPSSKSTSGGTAALGCLVKDYFPEPVTVSWNSGALTSGVHTFPAVLQSSGLYSLSSVVTVPSSSL
GTQTYICNVNHKPSDTKVDKKVEPKSCDKTHTCPPCPAPPVAGPSVFLFPPKPKDTLMISRTPEVTCVVVDVKHEDP
EVKFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVFSC
SVMHEALHNHYTQKSLSLSPGK scFv Chain 2 – 1C11[PD-1]_H3.241_L3.148_scFv(GKPGS)4_Fc(216)_IgG1_C220S/PVA_/S267K/S364K/E357Q (SEQ ID NOS 44789-44798 and linker disclosed as SEQ ID NO: 39202)
EVQLVQSGPELKKPGESVKVSCKASGYTFTHYGINWVRQPPGQGLEWMGWINTYTGEPYYAPGFQERFVFSIDTSQD
TAYLQINSLKAEDTAVYYCARDYYGSSPYWGQGTLVTVSS/GKPGSGKPGSGKPGSGKPGS/DVLMTQSPDSLAVSL
GERATINCKSSQSIVHSNGNTYLEWYQQKPGQSPKLLIYKVSNRFSGVPDRFSGSGSGTDFTLTISSLQAEDVAVYY
CFQGSHVPNTFGGGTKVEIK/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VMHEALHNHYTQKSLSLSPGK

Light Chain 3 – [αXXX]_LX (SEQ ID NO: 44799)
/RTVAAPSVFIFPPSDEQLKSGTASVVCLLNNFYPREAKVQWKVDNALQSGNSQESVTEQDSKDSTYSLSSTLTLSK
ADYEKHKVYACEVTHQGLSSPVTKSFNRGEC XENCS559 (BO skeleton 4)

> [αXXX]_HXLX_Fab-1C11[PD-1]_H3.241_L3.92_scFv(GKPGS)4-IgG1_pI(-)_Isosteric_A_/PVA_/S267K/L368D/K370S-Fc(216)_IgG1_C220S/PVA_/S267K/S364K/E357Q

FIG. 50C

Fab Chain 1 – [αXXX]_HX_ IgG1_pI(-)_Isosteric_A_/PVA_/S267K/L368D/K370S (SEQ ID NO: 44800)
/ASTKGPSVFPLAPSSKSTSGGTAALGCLVKDYFPEPVTVSWNSGALTSGVHTFPAVLQSSGLYSLSSVVTVPSSSL
GTQTYICNVNHKPSDTKVDKKVEPKSCDKTHTCPPCPAPPVAGPSVFLFPPKPKDTLMISRTPEVTCVVVDVKHEDP
EVKFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVFSC
SVMHEALHNHYTQKSLSLSPGK scFv Chain 2 – 1C11[PD-1]_H3.241_L3.92_scFv(GKPGS)4_Fc(216)_IgG1_C220S/PVA_/S267K/S364K/E357Q (SEQ ID NOS 44801-44810 and linker disclosed as SEQ ID NO: 39202)
EVQLVQSGPELKKPGESVKVSCKASGYTFTHYGINWVRQPPGQGLEWMGWINTYTGEPYYAPGFQERFVFSIDTSQD
TAYLQINSLKAEDTAVYYCARDYYGSSPYWGQGTLVTVSS/GKPGSGKPGSGKPGSGKPGS/DIVMTQSPDSLAVSL
GERVTINCKASQSIVHSNGNTYLEWYQQKPGQPPKLLIYKVSNRFTGVPDRFSGSGSGTDFTLTISSLQAEDVAVYY
CFQGSHVPNTFGGGTKVEIK/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VMHEALHNHYTQKSLSLSPGK

Light Chain 3 – [αXXX]_LX (SEQ ID NO: 44811)
/RTVAAPSVFIFPPSDEQLKSGTASVVCLLNNFYPREAKVQWKVDNALQSGNSQESVTEQDSKDSTYSLSSTLTLSK
ADYEKHKVYACEVTHQGLSSPVTKSFNRGEC

XENCS560 (BO skeleton 5)

> [αXXX]_HXLX_Fab-1C11[PD-1]_H3.234_L3.144_scFv(GKPGS)4-IgG1_pI(-)_Isosteric_A_/PVA_/S267K/L368D/K370S/M428L/N434S-Fc(216)_IgG1_C220S/PVA_/S267K/S364K/E357Q/M428L/N434S

Fab Chain 1 – [αXXX]_HX_IgG1_pI(-)_Isosteric_A_/PVA_/S267K/L368D/K370S/M428L/N434S (SEQ ID NO: 44812)
/ASTKGPSVFPLAPSSKSTSGGTAALGCLVKDYFPEPVTVSWNSGALTSGVHTFPAVLQSSGLYSLSSVVTVPSSSL
GTQTYICNVNHKPSDTKVDKKVEPKSCDKTHTCPPCPAPPVAGPSVFLFPPKPKDTLMISRTPEVTCVVVDVKHEDP
EVKFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVFSC
SVLHEALHSHYTQKSLSLSPGK scFv Chain 2 – 1C11[PD-1]_H3.234_L3.144_scFv(GKPGS)4_Fc(216)_IgG1_C220S/PVA_/S267K/S364K/E357Q/M428L/N434S (SEQ ID NOS 44813-44822 and linker disclosed as SEQ ID NO: 39202)
EVQLVQSGSELKKPGESVKVSCKASGYTFTHYGINWVRQPPGQGLEWMGWINTYTGEPYYAPGFQERFVFSLDTSQD
TAYLQINSLKAEDTAVYYCARDYYGSSPYWGQGTLVTVSS/GKPGSGKPGSGKPGSGKPGS/DIVMTQSPDSLAVSL
GERVTINCKASQSIVHSNGNTYLEWYQQKPGQPPKLLIYKVSNRFSGVPDRFSGSGSGTDFTLTISSVEAEDAATYY
CFQGSHVPNTFGQGTKVEIK/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VLHEALHSHYTQKSLSLSPGK

FIG. 50D

Light Chain 3 – [αXXX]_LX (SEQ ID NO: 44823)
/RTVAAPSVFIFPPSDEQLKSGTASVVCLLNNFYPREAKVQWKVDNALQSGNSQESVTEQDSKDSTYSLSSTLTLSK
ADYEKHKVYACEVTHQGLSSPVTKSFNRGEC XENCS561 (BO skeleton 6)

**> [αXXX]_HXLX_Fab-1C11[PD-1]_H3.240_L3.148_scFv(GKPGS)4-IgG1_pI(-
)_Isosteric_A_/PVA_/S267K/L368D/K370S/M428L/N434S-
Fc(216)_IgG1_C220S/PVA_/S267K/S364K/E357Q/M428L/N434S**

Fab Chain 1 – [αXXX]_HX_IgG1_pI(-)_Isosteric_A_/PVA_/S267K/L368D/K370S/M428L/N434S (SEQ ID NO: 44824)
/ASTKGPSVFPLAPSSKSTSGGTAALGCLVKDYFPEPVTVSWNSGALTSGVHTFPAVLQSSGLYSLSSVVTVPSSSL
GTQTYICNVNHKPSDTKVDKKVEPKSCDKTHTCPPCPAPPVAGPSVFLFPPKPKDTLMISRTPEVTCVVVDVKHEDP
EVKFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVFSC
SVLHEALHSHYTQKSLSLSPGK

**scFv Chain 2 – 1C11[PD-
1]_H3.240_L3.148_scFv(GKPGS)4_Fc(216)_IgG1_C220S/PVA_/S267K/S364K/E357Q/M428L/N434S** (SEQ ID NOS
44825-44834 and linker disclosed as SEQ ID NO: 39202)
QVQLVQSGPELKKPGESVKVSCKASGYTFT<u>HYGINW</u>VRQPPGQGLEWMG<u>WINTYTGEPYYAPGFQER</u>FVFSIDTSQD
TAYLQINSLKAEDTAVYYCARD<u>YYGSSPYW</u>GQGTLVTVSS/<u>GKPGSGKPGSGKPGSGKPGS</u>/DVLMTQSPDSLAVSL
GERATINCK<u>SSQSIVHSNGNTYLE</u>WYQQKPGQSPKLLIY<u>KVSNRF</u>SGVPDRFSGSGSGTDFTLTISSLQAEDVAVYY
CF<u>QGSHVPNTFGGG</u>TKVEIK/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VLHEALHSHYTQKSLSLSPGK

Liight Chain 3 – [αXXX]_LX (SEQ ID NO: 44835)
/RTVAAPSVFIFPPSDEQLKSGTASVVCLLNNFYPREAKVQWKVDNALQSGNSQESVTEQDSKDSTYSLSSTLTLSK
ADYEKHKVYACEVTHQGLSSPVTKSFNRGEC XENCS562 (BO skeleton 7)

**> [αXXX]_HXLX_Fab-1C11[PD-1]_H3.241_L3.148_scFv(GKPGS)4-IgG1_pI(-
)_Isosteric_A_/PVA_/S267K/L368D/K370S/M428L/N434S-
Fc(216)_IgG1_C220S/PVA_/S267K/S364K/E357Q/M428L/N434S**

Fab Chain 1 – [αXXX]_HX_IgG1_pI(-)_Isosteric_A_/PVA_/S267K/L368D/K370S/M428L/N434S (SEQ ID NO: 44836)
/ASTKGPSVFPLAPSSKSTSGGTAALGCLVKDYFPEPVTVSWNSGALTSGVHTFPAVLQSSGLYSLSSVVTVPSSSL
GTQTYICNVNHKPSDTKVDKKVEPKSCDKTHTCPPCPAPPVAGPSVFLFPPKPKDTLMISRTPEVTCVVVDVKHEDP
EVKFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVFSC
SVLHEALHSHYTQKSLSLSPGK

FIG. 50E scFv Chain 2 – 1C11[PD-1]_H3.241_L3.148_scFv(GKPGS)4_Fc(216)_IgG1_C220S/PVA_/S267K/S364K/E357Q/M428L/N434S (SEQ ID NOS 44837-44846 and linker disclosed as SEQ ID NO: 39202)
EVQLVQSGPELKKPGESVKVSCKASGYTFTHYGINWVRQPPGQGLEWMGWINTYTGEPYYAPGFQERFVFSIDTSQD
TAYLQINSLKAEDTAVYYCARDYYGSSPYWGQGTLVTSS/GKPGSGKPGSGKPGSGKPGS/DVLMTQSPDSLAVSL
GERATINCKSSQSIVHSNGNTYLEWYQQKPGQSPKLLIYKVSNRFSGVPDRFSGSGSGTDFTLTISSLQAEDVAVYY
CFQGSHVPNTFGGGTKVEIK/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VLHEALHSHYTQKSLSLSPGK

Light Chain 3 – [αXXX]_LX (SEQ ID NO: 44847)
/RTVAAPSVFIFPPSDEQLKSGTASVVCLLNNFYPREAKVQWKVDNALQSGNSQESVTEQDSKDSTYSLSSTLTLSK
ADYEKHKVYACEVTHQGLSSPVTKSFNRGEC XENCS563 (BO skeleton 8)

>[αXXX]_HXLX_Fab-1C11[PD-1]_H3.241_L3.92_scFv(GKPGS)4-IgG1_pI(-)_Isosteric_A_/PVA_/S267K/L368D/K370S/M428L/N434S-Fc(216)_IgG1_C220S/PVA_/S267K/S364K/E357Q/M428L/N434S

Fab Chain 1 – [αXXX]_HX_IgG1_pI(-)_Isosteric_A_/PVA_/S267K/L368D/K370S/M428L/N434S (SEQ ID NO: 44848)
/ASTKGPSVFPLAPSSKSTSGGTAALGCLVKDYFPEPVTVSWNSGALTSGVHTFPAVLQSSGLYSLSSVVTVPSSSL
GTQTYICNVNHKPSDTKVDKKVEPKSCDKTHTCPPCPAPPVAGPSVFLFPPKPKDTLMISRTPEVTCVVVDVKHEDP
EVKFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVFSC
SVLHEALHSHYTQKSLSLSPGK scFv Chain 2 – 1C11[PD-1]_H3.241_L3.92_scFv(GKPGS)4_Fc(216)_IgG1_C220S/PVA_/S267K/S364K/E357Q/M428L/N434S (SEQ ID NOS 44849-44858 and linker disclosed as SEQ ID NO: 39202)
EVQLVQSGPELKKPGESVKVSCKASGYTFTHYGINWVRQPPGQGLEWMGWINTYTGEPYYAPGFQERFVFSIDTSQD
TAYLQINSLKAEDTAVYYCARDYYGSSPYWGQGTLVTSS/GKPGSGKPGSGKPGSGKPGS/DIVMTQSPDSLAVSL
GERVTINCKASQSIVHSNGNTYLEWYQQKPGQPPKLLIYKVSNRFTGVPDRFSGSGSGTDFTLTISSLQAEDVAVYY
CFQGSHVPNTFGGGTKVEIK/EPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCS
VLHEALHSHYTQKSLSLSPGK

Light Chain 3 – [αXXX]_LX (SEQ ID NO: 44859)
/RTVAAPSVFIFPPSDEQLKSGTASVVCLLNNFYPREAKVQWKVDNALQSGNSQESVTEQDSKDSTYSLSSTLTLSK
ADYEKHKVYACEVTHQGLSSPVTKSFNRGEC Binding avidity of XmAb20717 contributes to T cell activation

FIG. 73

>XENP015074 Numax_IgG1_PVA_/S267K Heavy Chain (SEQ ID NOS 44860-44864)
QVTLRESGPALVKPTQTLTLTCTFSGFSLSTAGMSVGWIRQPPGKALEWLADIWWDDKKHYNPSLKDRLTISKDTSK
NQVVLKVTNMDPADTATYYCARDMIFNFYFDVWGQGTTVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK

>XENP015074 Numax_IgG1_PVA_/S267K Light Chain (SEQ ID NOS 44865-44869)
DIQMTQSPSTLSASVGDRVTITCSASSRVGYMHWYQQKPGKAPKLLIYDTSKLASGVPSRFSGSGSGTEFTLTISSL
QPDDFATYYCFQGSGYPFTFGGGTKVEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

FIG. 74

>XENP016432 Nivolumab_H0L0_IgG1_PVA_/S267K Heavy Chain (SEQ ID NOS 44870-44874)
QVQLVESGGGVVQPGRSLRLDCKASGITFSNSGMHWVRQAPGKGLEWVAVIWYDGSKRYYADSVKGRFTISRDNSKN
TLFLQMNSLRAEDTAVYYCATNDDYWGQGTLVTVSS/ASTKGPSVFPLAPSSKSTSGGTAALGCLVKDYFPEPVTVS
WNSGALTSGVHTFPAVLQSSGLYSLSSVVTVPSSSLGTQTYICNVNHKPSNTKVDKKVEPKSCDKTHTCPPCPAPPV
AGPSVFLFPPKPKDTLMISRTPEVTCVVVDVKHEDPEVKFNWYVDGVEVHNAKTKPREEQYNSTYRVVSVLTVLHQD
WLNGKEYKCKVSNKALPAPIEKTISKAKGQPREPQVYTLPPSREEMTKNQVSLTCLVKGFYPSDIAVEWESNGQPEN
NYKTTPPVLDSDGSFFLYSKLTVDKSRWQQGNVFSCSVMHEALHNHYTQKSLSLSPGK

>XENP016432 Nivolumab_H0L0_IgG1_PVA_/S267K Light Chain (SEQ ID NOS 44875-44879)
EIVLTQSPATLSLSPGERATLSCRASQSVSSYLAWYQQKPGQAPRLLIYDASNRATGIPARFSGSGSGTDFTLTISS
LEPEDFAVYYCQQSSNWPRTFGQGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

FIG. 75

>XENP021461 Pembrolizumab_H0L0_IgG4_S228P Heavy Chain (SEQ ID NOS 44880-44884)
QVQLVQSGVEVKKPGASVKVSCKASGYTFTNYYMYWVRQAPGQGLEWMGGINPSNGGTNFNEKFKNRVTLTTDSSTT
TAYMELKSLQFDDTAVYYCARRDYRFDMGFDYWGQGTTVTVSS/ASTKGPSVFPLAPCSRSTSESTAALGCLVKDYF
PEPVTVSWNSGALTSGVHTFPAVLQSSGLYSLSSVVTVPSSSLGTKTYTCNVDHKPSNTKVDKRVESKYGPPCPPCP
APEFLGGPSVFLFPPKPKDTLMISRTPEVTCVVVDVSQEDPEVQFNWYVDGVEVHNAKTKPREEQFNSTYRVVSVLT
VLHQDWLNGKEYKCKVSNKGLPSSIEKTISKAKGQPREPQVYTLPPSQEEMTKNQVSLTCLVKGFYPSDIAVEWESN
GQPENNYKTTPPVLDSDGSFFLYSRLTVDKSRWQEGNVFSCSVMHEALHNHYTQKSLSLSLGK

>XENP021461 Pembrolizumab_H0L0_IgG4_S228P Light Chain (SEQ ID NOS 44885-44889)
EIVLTQSPATLSLSPGERATLSCRASKGVSTSGYSYLHWYQQKPGQAPRLLIYLASYLESGVPARFSGSGSGTDFTL
TISSLEPEDFAVYYCQHSRDLPLTFGGGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

FIG. 79

| Test Article | $C_{max}$ (µg/mL) | $V_d$ (mL/kg) | $t_{1/2}$ (days) | AUC∞ (day*µg/mL) | CL (mL/day/kg) | $V_{ss}$ (mL/kg) | MRTinf_pred (days) |
|---|---|---|---|---|---|---|---|
| XENP20053 | 42.92 | 48.1 | 3.8 | 185.5 | 11.1 | 53.4 | 4.8 |
| XmAb20717 | 27.57 | 73.0 | 9.0 | 227.9 | 808 | 107.5 | 12.2 |

FIG. 83

| XmAb20717 binding partner | Human | | | Cynomolgus Monkey | | |
|---|---|---|---|---|---|---|
| | $K_D$ (M) | $k_a$ (1/Ms) | $k_d$ (1/s) | $K_D$ (M) | $k_a$ (1/Ms) | $k_d$ (1/s) |
| CTLA4 | $4.1 \times 10^{-9}$ | $2.9 \times 10^5$ | $1.2 \times 10^{-3}$ | $2.3 \times 10^{-8}$ | $4.0 \times 10^5$ | $9.1 \times 10^{-3}$ |
| PD1 | $1.4 \times 10^{-9}$ | $3.1 \times 10^5$ | $4.3 \times 10^{-4}$ | $5.5 \times 10^{-9}$ | $1.9 \times 10^5$ | $1.1 \times 10^{-3}$ |

FIG. 89

| Receptor | $K_D$ (M) | |
|---|---|---|
| | XmAb20717 | XENP20053 |
| Human FcRn | $2.9 \times 10^{-7}$ | $7.5 \times 10^{-5}$ |
| Cynomolgus FcRn | $5.1 \times 10^{-7}$ | Low binding signal |
| Mouse FcRn | $4.6 \times 10^{-8}$ | $1.4 \times 10^{-7}$ |

FIG. 99

>XENP16434 YW243.55.S70_H0L0_IgG1_PVA_/S267K
XENP16434 YW243.55.S70_H0 Heavy Chain (SEQ ID NOS 44890-44894)
EVQLVESGGGLVQPGGSLRLSCAASGFTFSDSWIHWVRQAPGKGLEWVAWISPYGGSTYYADSVKGRFTI
SADTSKNTAYLQMNSLRAEDTAVYYCARRHWPGGFDYWGQGTLVTVSS/ASTKGPSVFPLAPSSKSTSGG
TAALGCLVKDYFPEPVTVSWNSGALTSGVHTFPAVLQSSGLYSLSSVVTVPSSSLGTQTYICNVNHKPSN
TKVDKKVEPKSCDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVY
TLPPSREEMTKNQVSLTCLVKGFYPSDIAVEWESNGQPENNYKTTPPVLDSDGSFFLYSKLTVDKSRWQQ
GNVFSCSVMHEALHNHYTQKSLSLSPGK

XENP16434 YW243.55.S70_L0 Light Chain (SEQ ID NOS 44895-44899)
DIQMTQSPSSLSASVGDRVTITCRASQDVSTAVAWYQQKPGKAPKLLIYSASFLYSGVPSRFSGSGSGTD
FTLTISSLQPEDFATYYCQQYLYHPATFGQGTKVEIK/RTVAAPSVFIFPPSDEQLKSGTASVVCLLNNF
YPREAKVQWKVDNALQSGNSQESVTEQDSKDSTYSLSSTLTLSKADYEKHKVYACEVTHQGLSSPVTKSF
NRGEC

FIG. 107

>XENP29154_TGN1412_hu5.11A1[CD28]_H1L1_IgG4_K447del

XENP29154_TGN1412_hu5.11A1[CD28]_H1_IgG4_K447del Heavy Chain (SEQ ID NOS 44900-44904)

EVQLVESGGGLVQPGGSLRLSCAASGFTFSDSWIHWVRQAPGKGLEWVAWISPYGGSTYYADSVKGRFTISADTSKN
TAYLQMNSLRAEDTAVYYCARRHWPGGFDYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCPAPP
VAGPSVFLFPPKPKDTLMISRTPEVTCVVVDVKHEDPEVKFNWYVDGVEVHNAKTKPREEQYNSTYRVVSVLTVLHQD
WLNGKEYKCKVSNKALPAPIEKTISKAKGQPREPQVYTLPPSREEMTKNQVSLTCLVKGFYPSDIAVEWESNGQPENNY
KTTPPVLDSDGSFFLYSKLTVDKSRWQQGNVFSCSVMHEALHNHYTQKSLSLSPGK

XENP29154 TGN1412_hu5.11A1[CD28]_ L1 Light Chain (SEQ ID NOS 44905-44909)

DIQMTQSPSSLSASVGDRVTITCRASQDVSTAVAWYQQKPGKAPKLLIYSASFLYSGVPSRFSGSGSGTDFTLTISSLQP
EDFATYYCQQYLYHPATFGQGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

FIG. 111

| XmAb22841 Binding Partner | Human | | | Cynomolgus Monkey | | |
|---|---|---|---|---|---|---|
| | $K_D$ (nM) | $k_a$ (1/Ms) | $k_d$ (1/s) | $K_D$ (nM) | $k_a$ (1/Ms) | $k_d$ (1/s) |
| CTLA4 | 4.6 | $1.6 \times 10^5$ | $7.3 \times 10^{-4}$ | 17.6 | $1.7 \times 10^5$ | $2.9 \times 10^{-3}$ |
| LAG3 | 1.4 | $8.1 \times 10^4$ | $1.2 \times 10^{-4}$ | 1.3 | $8.2 \times 10^5$ | $1.0 \times 10^{-3}$ |

FIG. 117

| Receptor | $K_D$ (M) | |
|---|---|---|
| | XmAb22841 | XENP22602 |
| Human FcRn | $1.4 \times 10^{-7}$ | $2.3 \times 10^{-6}$ |
| Cynomolgus monkey FcRn | $9.5 \times 10^{-8}$ | $1.2 \times 10^{-6}$ to $1.6 \times 10^{-7}$ [a] |
| Mouse FcRn | $6.3 \times 10^{-8}$ | $1.9 \times 10^{-7}$ |

BISPECIFIC AND MONOSPECIFIC ANTIBODIES USING NOVEL ANTI-PD-1 SEQUENCES

I. PRIORITY CLAIM

This application claims priority to U.S. Patent Application Nos. 62/583,438, filed Nov. 8, 2017; 62/598,938, filed Dec. 14, 2017 and 62/658,227, filed Apr. 16, 2018 all of which are expressly incorporated herein by reference in their entirety, with particular reference to the figures, legends, and claims therein.

II. SEQUENCE LISTING

The instant application contains a Sequence Listing which has been submitted electronically in ASCII format and is hereby incorporated by reference in its entirety. Said ASCII copy, created on May 7, 2019, is named 067461-5215-WO_SL_v2.txt and is 39,084,712 kilobytes in size.

III. BACKGROUND OF THE INVENTION

Checkpoint receptors such as CTLA-4, PD-1 (programmed cell death 1), TIM-3 (T cell immunoglobulin and mucin domain 3), LAG-3 (lymphocyte-activation gene 3), TIGIT (T cell immunoreceptor with Ig and ITIM domains), and others, inhibit the activation, proliferation, and/or effector activities of T cells and other cell types. Guided by the hypothesis that checkpoint receptors suppress the endogenous T cell response against tumor cells, preclinical and clinical studies of anti-CTLA4 and anti-PD1 antibodies, including nivolumab, pembrolizumab, ipilimumab, and tremelimumab, have indeed demonstrated that checkpoint blockade results in impressive anti-tumor responses, stimulating endogenous T cells to attack tumor cells, leading to long-term cancer remissions in a fraction of patients with a variety of malignancies. Unfortunately, only a subset of patients responds to these therapies, with response rates generally ranging from 10 to 30% and sometimes higher for each monotherapy, depending on the indication and other factors. Therapeutic combination of these agents, for example ipilimumab plus nivolumab, leads to even higher response rates, approaching 60% in some cases. Preclinical studies have shown additional synergies between anti-PD-1 antibodies and/or anti-CTLA-4 antibodies with blockade of more recently identified checkpoint receptors, including LAG-3, TIM-3, BTLA and TIGIT. While the potential of multiple checkpoint blockade is very promising, combination therapy with such agents is expected to carry a high financial burden. Moreover, autoimmune toxicities of combination therapies, for example nivolumab plus ipilimumab, are significantly elevated compared to monotherapy, causing many patients to halt the therapy.

A number of studies (Ahmadzadeh et al., Blood 114:1537 (2009), Matsuzaki et al., PNAS 107(17):7875-7880 (2010), Fourcade et al., Cancer Res. 72(4):887-896 (2012) and Gros et al., J. Clinical Invest. 124(5):2246 (2014)) examining tumor-infiltrating lymphocytes (TILs) have shown that TILs commonly express multiple checkpoint receptors. Moreover, it is likely that TILs that express multiple checkpoints are in fact the most tumor-reactive. In contrast, non-tumor reactive T cells in the periphery are more likely to express a single checkpoint. Checkpoint blockade with monospecific full-length antibodies is likely nondiscriminatory with regards to de-repression of tumor-reactive TILs versus autoantigen-reactive single expressing T cells that are assumed to contribute to autoimmune toxicities.

Accordingly, the invention is directed to bispecific antibodies that bind to human PD-1 and a second, different checkpoint inhibitor protein. Also provided are monospecific monoclonal antibodies that bind to human PD-1.

IV. BRIEF SUMMARY OF THE INVENTION

The present invention is directed to novel anti-PD-1 antigen binding domains (ABDs) and their uses in the creation of anti-PD-1 monovalent monoclonal antibodies and heterodimeric, bispecific antibodies that bind to PD-1 and a second target antigen selected from the group consisting of CTLA-4, LAG-3, TIM-3, TIGIT, BTLA and ICOS, and methods of making and using the antibodies.

Accordingly, in some aspects the invention provides anti-PD-1 monovalent monoclonal antibodies. In this aspect, the anti-PD-1 monoclonal antibody comprising: a) a heavy chain comprising, from N- to C-terminal, VH-CH1-hinge-CH2-CH3; and b) a light chain comprising, from N- to C-terminal, VL-CL; wherein the VHCDR1, VHCDR2, VHCDR3, VLCDR1, VLCDR2 and VLCDR3 are selected from the group consisting of the CDRs from XENP26940 in FIG. 24 and the CDRs from XNE28652 in FIG. 40.

In an additional aspect, the antibody has a VH and VL from XENP26940 depicted in FIG. 24.

In a further aspect, the antibody has a VH and VL from XENP28652 depicted in FIG. 40.

In either aspect, the hinge-CH2-CH3 can be an Fc domain selected from the group consisting of the Fc domain from human IgG1, IgG2, IgG3 and IgG4. When from IgG1, the Fc domain can be a variant human IgG1 domain, for example including the amino acid substitutions 427L/434S. Additionally, the variant IgG1 Fc domain can comprise ablation variants selected from those depicted in FIG. 5, and in particular the E233P/L234V/L235A/G236del/S267K substitutions. When the Fc domain is a variant human IgG4 domain it can comprise an S228P amino acid substitution.

In further aspects, the invention provides nucleic acid compositions comprising a first nucleic acid encoding the heavy chain and a second nucleic acid encoding the light chain. Also included are expression vector compositions comprising a first expression vector comprising the first nucleic acid and a second expression vector comprising said second nucleic acid, or a single expression vector comprising said first and second nucleic acids. Further included are host cells comprising the expression vector composition or expression vectors. Methods of making the anti-PD-1 antibodies are also included, comprising culturing the host cells under conditions wherein said antibody is expressed, and recovering said antibody. Furthermore, the invention provides methods of treating cancer in a patient in need thereof comprising administering the antibody to said patient.

In a further aspect, heterodimeric bispecific antibodies are provided. These antibodies comprise: a) a first monomer comprising: i) a single chain Fv domain (scFv) that binds human PD-1, wherein said scFv domain comprises: 1) a first variable heavy domain (VH1); 2) a scFv linker; and 3) a first variable light domain (VL1); and ii) a first variant Fc domain; b) a second monomer comprising: i) a heavy chain comprising a second variable heavy domain (VH2)-CH1-hinge-CH2-CH3; and c) a light chain comprising a second variable light domain (VL2) and a constant light domain (CL); wherein said first variable heavy domain and said first variable light domain form a first antigen binding domain (ABD1) and wherein said second variable heavy domain and said second variable light domain form a second ABD (ABD2) that binds to an antigen selected from human CTLA-4, human LAG-3, human TIM-3, human TIGIT, human BTLA and human ICOS. ABD1 can be any of the 1C11 VH and VL domains as outlined in FIGS. 13, 15, 16, 18, 20, 21, 24, 33 and 40.

In particular aspects, the ABD1 has sequences selected from the pairs consisting of 1C11[PD-1]_H3.234_L3.144 from XENP25806 in FIG. 15, 1C11[PD-1]_H3.240_L3.148 from XENP25812 from FIG. 15, 1C11[PD-1]_H3.241_L3.148 from XENP25813 in FIG. 15 and 1C11[PD-1]_H3.241_L3.92 from XENP25819 in FIG. 15.

In these aspects, the first monomer can comprise, from N- to C-terminal, VH1-scFv linker-VIA-hinge-variant Fc domain.

In further aspects, the first monomer can comprise, from N- to C-terminal, VL1-scFv linker-VH1-hinge-variant Fc domain.

In particular aspects, the ABD1 has sequences selected from the pairs consisting of 1C11[PD-1]_H3.234_L3.144 from XENP25806 in FIG. 15, 1C11[PD-1]_H3.240_L3.148 from XENP25812 from FIG. 15, 1C11[PD-1]_H3.241_L3.148 from XENP25813 in FIG. 15 and 1C11[PD-1]_H3.241_L3.92 from XENP25819 in FIG. 15, and the ABD2 binds to an antigen selected from human CTLA-4, human LAG-3, human TIM-3, human TIGIT, human BTLA and human ICOS.

In an additional aspect, the anti-CTLA-4 ABD2 has sequences selected from the pairs of SEQ ID NOs:38134 and 38138, 36739 and 36743, 36747 and 36751, 36755 and 36759, 36763 and 36767, 36771 and 36775, 36779 and 36783, 36787 and 36791, 36795 and 36799, 36803 and 36807, and 36811 and 36815 of the sequence listing.

In an additional aspect, the anti-LAG-3 ABD2 has sequences selected from the pairs of SEQ ID NOs:32755 and 32760, 36819 and 36823, 36827 and 36831, 36835 and 36839, 36843 and 36847, 36851 and 36855, 36859 and 36863, 36867 and 36871, 36875 and 36879, 36883 and 36887, 36891 and 36895, 36899 and 36903, 36907 and 36911, 36915 and 36919, 36923 and 36927, 36931 and 36935, 36939 and 36943, 36947 and 36951 and 36955 and 36959.

In an additional aspect, the anti-TIM-3 ABD2 has sequences selected from the pairs of SEQ ID NOs:36508 and 36513, 35757 and 37591, 37959 and 37599, 37603 and 37607, 37611 and 37615, 37619 and 37623, 37627 and 37631, 37635 and 37639, 37643 and 37647, 37651 and 37655, 37659 and 37663, 37667 and 37671, 37675 and 37679, 37683 and 37687 and 37691 and 37695.

In an additional aspect, the anti-TIGIT ABD2 has sequences selected from the pairs of SEQ ID NOs:37435 and 37439, 37443 and 37447, 37451 and 37455, 37459 and 37463, 37467 and 37471, 37475 and 37479, 37483 and 37487, 37491 and 37495, 37499 and 37503, 37507 and 37511, 37515 and 37519, 37523 and 37527, 37531 and 37535, 37539 and 37543, 37547 and 37551, 37555 and 37559, 37563 and 37567, 37571 and 37575 and 37579 and 37583.

In an additional aspect, the anti-ICOS ABD2 has sequences selected from the group consisting of: a) the pairs of SEQ ID NOs:26323 and 26328, 27477 and 27452 and 26353 and 26358 from the sequence listing from US2018/0127501; b) the VH and VL sequences of XENCS500 in FIG. 49; and c) the VH and VL sequences of XENCS501 in FIG. 49.

In an additional aspect, the anti-BTLA ABD2 has sequences selected from the pairs of SEQ ID NOs:20936 and 20941, 36707 and 36711, 36715 and 36719, 36723 and 36727 and 36761 and 36735.

In many aspects, the heterodimeric antibodies of the invention have a second variant IgG1 Fc domain comprises amino acid substitutions N208D/Q295E/N384D/Q418E/N421D, wherein said first and second variant IgG1 Fc domains each comprise amino acid substitutions E233P/L234V/L235A/G236del/S267K; and wherein said first variant IgG1 Fc domain comprises amino acid substitutions S364K/E357Q and second variant IgG1 Fc domain comprises amino acid substitutions L368D/K370S, wherein numbering is according to the EU index as in Kabat.

In further aspects, the invention provides nucleic acid compositions comprising: a) a first nucleic acid encoding said first monomer; b) a second nucleic acid encoding said second monomer; and c) a third nucleic acid encoding said light chain of any of claims 15 to 30.

In an additional aspect, the invention provides expression vector compositions comprising: a) a first expression vector comprising said first nucleic acid; b) a second expression vector comprising said second nucleic acid; and c) a third expression vector comprising said third nucleic acid. Also provided are host cells comprising the expression vector compositions, and methods of making the antibodies by culturing the host cells under conditions wherein said antibody is expressed, and recovering said antibody. Further provided are methods of treating cancer in a patient in need thereof comprising administering the heterodimeric bispecific antibodies of the invention to a patient.

V. BRIEF DESCRIPTION OF THE DRAWINGS

FIG. 1A to 1O depict several formats of the present invention. The first is the "bottle opener" format, with a first and a second anti-antigen binding domain. Additionally, mAb-Fv, mAb-scFv, Central-scFv, Central-Fv, one armed central-scFv, one scFv-mAb, scFv-mAb, a dual scFv format, DVD-Ig, Trident and mAb-(scFv2) are all shown. For all of the scFv domains depicted, they can be either N- to C-terminus variable heavy-(optional linker)-variable light, or the opposite. In addition, for the one armed scFv-mAb, the scFv can be attached either to the N-terminus of a heavy chain monomer or to the N-terminus of the light chain.

FIGS. 2A to 2D depicts the antigen sequences for a number of antigens of use in the invention, including both human and cynomolgus monkey in many cases, to facilitate the development of antigen binding domains that bind to both for ease of clinical development. Unless otherwise stated, all references to these antigens are to the human antigen. The sequence of human ICOS (sp|Q9Y6W8) is shown in SEQ ID NO: 26246 of WO/2018/045110. The sequence of human ICOS, extracellular domain (sp|Q9Y6W8|121-140) is SEQ ID NO: 26247 of WO/2018/045110.

FIG. 3A to 3F depict useful pairs of heterodimerization variant sets (including skew and pI variants). On FIG. 3E, there are variants for which there are no corresponding "monomer 2" variants; these are pI variants which can be used alone on either monomer, or included on the Fab side of a bottle opener, for example, and an appropriate charged scFv linker can be used on the second monomer that utilizes a scFv as the second antigen binding domain. Suitable charged linkers are shown in FIG. 7.

FIG. 4 depict a list of isosteric variant antibody constant regions and their respective substitutions. pI_(−) indicates lower pI variants, while pI_(+) indicates higher pI variants. These can be optionally and independently combined with other heterodimerization variants of the invention (and other variant types as well, as outlined herein).

FIG. 5 depict useful ablation variants that ablate FcγR binding (sometimes referred to as "knock outs" or "KO" variants). Generally, ablation variants are found on both monomers, although in some cases they may be on only one monomer.

FIGS. 6A and 6B show two particularly useful embodiments of the invention.

FIGS. 7A and 7B depict a number of charged scFv linkers that find use in increasing or decreasing the pI of heterodimeric antibodies that utilize one or more scFv as a component. The (+H) positive linker finds particular use herein, particularly with anti-CD3 vl and vh sequences shown herein. A single prior art scFv linker with a single charge is referenced as "Whitlow", from Whitlow et al., Protein Engineering 6(8):989-995 (1993). It should be noted that this linker was used for reducing aggregation and enhancing proteolytic stability in scFvs.

FIG. 8 depicts a list of engineered heterodimer-skewing Fc variants with heterodimer yields (determined by HPLC-CIEX) and thermal stabilities (determined by DSC). Not determined thermal stability is denoted by "n.d.".

FIG. 9 depicts the sequences for XENP21575, a chimeric anti-PD-1 antibody based on the variable regions of hybridoma done 1C11 and human IgG1 with E233P/L234V/L235A/G236del/S267K substitutions in the heavy chain. The CDRs are in bold, and the slashes indicate the borders of the variable domains. As noted herein and is true for every sequence herein containing CDRs, the exact identification of the CDR locations may be slightly different depending on numbering used as is shown in Table 1, and thus included herein are not only the CDRs that are underlined but also CDRs included within the VH and VL domains using other numbering systems. Additionally, each CDR has its own SEQ ID NO: in the sequence listing, and each VH and VL domain has its own SEQ ID NO: in the sequence listing.

FIG. 10 depicts blocking of PD-1/PD-L1 interaction on PD-1 transfected HEK293T cells by anti-PD-1 clone 1C11.

Figure 11:
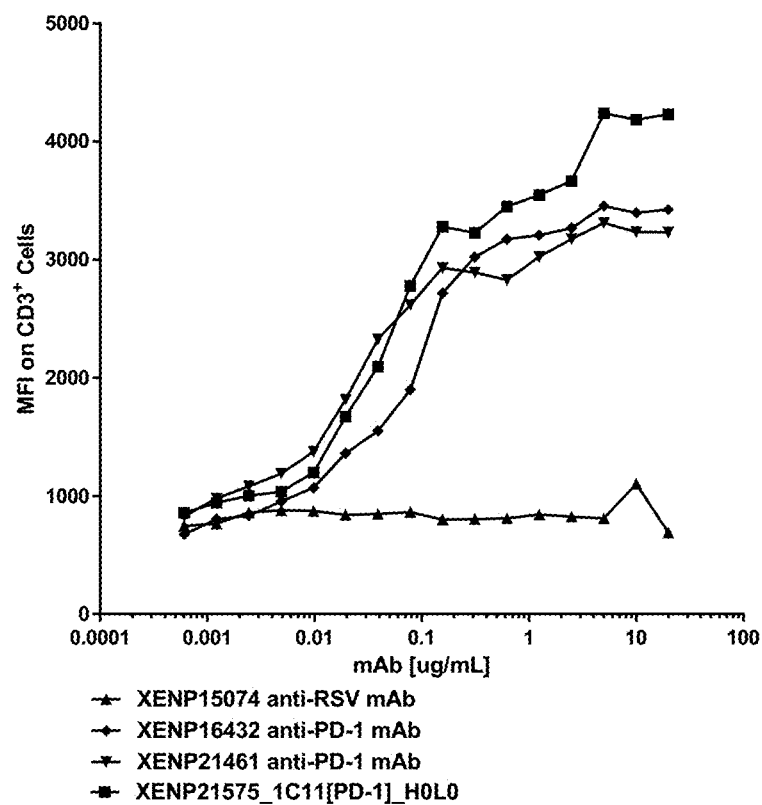

FIG. 11 depicts the binding of anti-PD-1 done 1C11 to SEB-stimulated T cells.

Figure 12A:
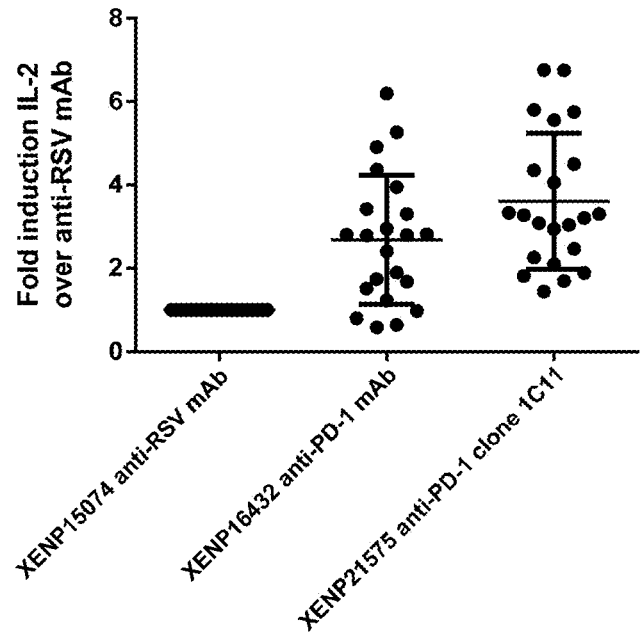
Figure 12B:
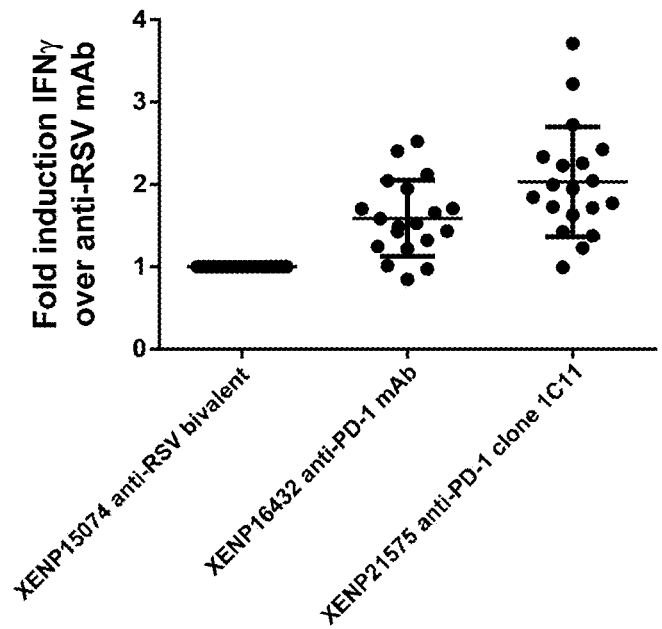

FIGS. 12A and 12B depict cytokine release assays (A: IL-2; B: IFNγ) after SEB stimulation of human PBMCs and treatment with anti-PD-1 done 1C11.

FIGS. 13A to 13C depict the sequences for illustrative Fab humanized variants of anti-PD-1 done 1C11 in the human IgG1 format with E233P/L234V/L235A/G236del/S267K substitutions in the heavy chain. The CDRs are in bold, and the slashes indicate the borders of the variable domains. As note herein and is true for every sequence herein containing CDRs, the exact identification of the CDR locations may be slightly different depending on numbering used as is shown in Table 1, and thus included herein are not only the CDRs that are underlined but also CDRs included within the VH and VL domains using other numbering systems. As will be appreciated by those in the art, the VH and VL domains can be formatted as Fab or scFvs. Additionally, each CDR has its own SEQ ID NO: in the sequence listing, and each VH and VL domain has its own SEQ ID NO: in the sequence listing.

Figure 14:
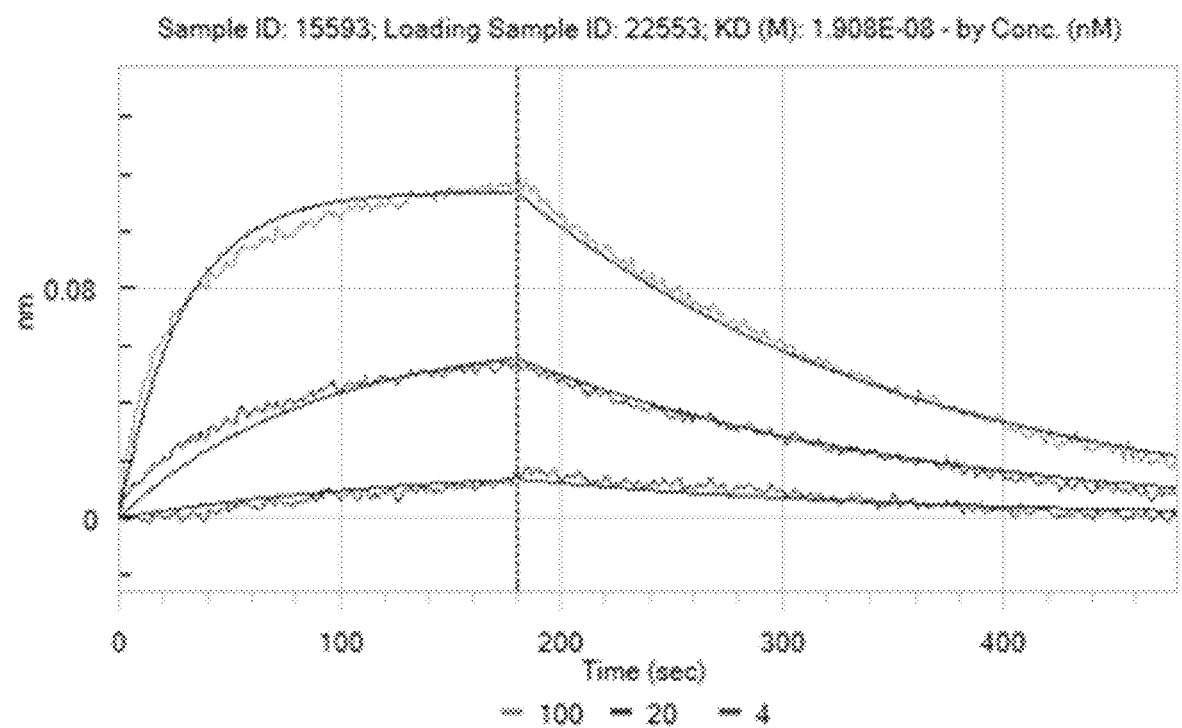

FIG. 14 depicts the affinity of XENP22553 for PD-1 as determined by Octet (as well as the associated sensorgram).

FIG. 15A to 15T depict sequences for illustrative scFv variants of anti-PD-1 done 1C11. The CDRs are underlined, the scFv linker is double underlined (in the sequences, the scFv linker is a positively charged scFv (GKPGS)4 linker, although as will be appreciated by those in the art, this linker can be replaced by other linkers, including uncharged or negatively charged linkers), and the slashes indicate the borders of the variable domains. As noted herein and is true for every sequence herein containing CDRs, the exact identification of the CDR locations may be slightly different depending on numbering used as is shown in Table 1 and thus included herein are not only the CDRs that are underlined but also CDRs included within the VH and VL domains using other numbering systems. Further, the naming convention illustrates the orientation of the scFv from N- to C-terminus; some of the sequences in this Figure are oriented as VH-scFv linker-VL (from N- to C-terminus), while some are oriented as VL-scFv linker-VH (from N- to C-terminus), although as will be appreciated by those in the art, these sequences may also be used in the opposition orientation from their depiction herein. Furthermore, as will be appreciated by those in the art, the VH and VL domains can be formatted as Fabs or scFvs. Additionally, each CDR has its own SEQ ID NO: in the sequence listing, and each VH and VL domain has its own SEQ ID NO: in the sequence listing.

FIGS. 16A and 16H depict sequences for illustrative variant anti-PD-1 mAbs with VH and VL domains from selected scFvs as described in Example XD. The CDRs are in bold, and the slashes indicate the borders of the variable domains. As noted herein and is true for every sequence herein containing CDRs, the exact identification of the CDR locations may be slightly different depending on numbering used as is shown in Table 1, and thus included herein are not only the CDRs that are underlined but also CDRs included within the VH and VL domains using other numbering systems. As will be appreciated by those in the art, the VH and VL domains can be formatted as Fabs or scFvs. Additionally, each CDR has its own SEQ ID NO: in the sequence listing, and each VH and VL domain has its own SEQ ID NO: in the sequence listing.

FIG. 17A to 17Q depict the stability of variant anti-PD-1 scFvs as determined by DSF and equilibrium dissociation constants (KD), association rates (ka), and dissociation rates (kd) of anti-PD-1 mAbs based on the VH/VL from the variant scFvs as determined by Octet. XENP for scFvs are in bold, and XENP for full-length mAb are in parentheses.

FIGS. 18A to 18G depict sequences for illustrative variant anti-PD-1 mAbs based on done 1C11. The CDRs are in bold, and the slashes indicate the borders of the variable domains. As noted herein and is true for every sequence herein containing CDRs, the exact identification of the CDR locations may be slightly different depending on numbering used as is shown in Table 1, and thus included herein are not only the CDRs that are underlined but also CDRs included within the VH and VL domains using other numbering systems. As will be appreciated by those in the art, the VH and VL domains can be formatted as Fabs or scFvs. Additionally, each CDR has its own SEQ ID NO: in the sequence listing, and each VH and VL domain has its own SEQ ID NO: in the sequence listing.

FIG. 19 depicts the of equilibrium dissociation constants (KD), association rates (ka), and dissociation rates (kd) of variant anti-PD-1 mAbs as determined by Octet.

FIGS. 20A to 20L depict sequences for variant heavy chains based on the heavy chain of XENP22553. The CDRs are in bold. As noted herein and is true for every sequence herein containing CDRs, the exact identification of the CDR locations may be slightly different depending on numbering used as is shown in Table 1, and thus included herein are not only the CDRs that are underlined but also CDRs included within the VH domain. As will be appreciated by those in the art, the VH domains can be used in Fabs or scFvs. Additionally, each CDR has its own SEQ ID NO: in the sequence listing, and each VH domain has its own SEQ ID NO: in the sequence listing.

FIGS. 21A to 21G depict sequences for variant light chains based on the light chain of XENP22553. The CDRs are in bold. As noted herein and is true for every sequence herein containing CDRs, the exact identification of the CDR locations may be slightly different depending on numbering used as is shown in Table 1, and thus included herein are not only the CDRs that are underlined but also CDRs included within the VL domains using other numbering systems. As will be appreciated by those in the art, the VL domains can be used in Fabs or scFvs. Additionally, each CDR has its own SEQ ID NO: in the sequence listing, and each VL domain has its own SEQ ID NO: in the sequence listing.

FIGS. 22A to 22E depict the of equilibrium dissociation constants (KD), association rates (ka), and dissociation rates (kd) of variant anti-PD-1 mAbs as determined by Octet. Variants are defined by heavy chain and light chain XenDs as depicted in FIGS. 20A-20L and FIGS. 21A-21G.

FIG. 23 depicts the of equilibrium dissociation constants (KD), association rates (ka), and dissociation rates (kd) of variant anti-PD-1 mAbs as determined by Octet. Variants are defined by heavy chain and light chain XenDs as depicted in FIG. 20 and FIG. 21.

FIGS. 24A to 24J depict sequences for additional illustrative variant anti-PD-1 mAbs based on done 1C11. The CDRs are underlined, and the slashes indicate the borders of the variable domains. As noted herein and is true for every sequence herein containing CDRs, the exact identification of the CDR locations may be slightly different depending on numbering used as is shown in Table 1, and thus included herein are not only the CDRs that are underlined but also CDRs included within the VH and VL domains using other numbering systems. As will be appreciated by those in the art, the VH and VL domains can be formatted as Fabs or scFvs. Additionally, each CDR has its own SEQ ID NO: in the sequence listing, and each VH and VL domain has its own SEQ ID NO: in the sequence listing.

FIG. 25 depicts the of equilibrium dissociation constants (KD), association rates (ka), and dissociation rates (kd) of variant anti-PD-1 mAbs as determined by Octet.

FIG. 26 depicts the affinity (KD) of anti-PD-1 1C11 variants as determined by Biacore.

Figure 27:
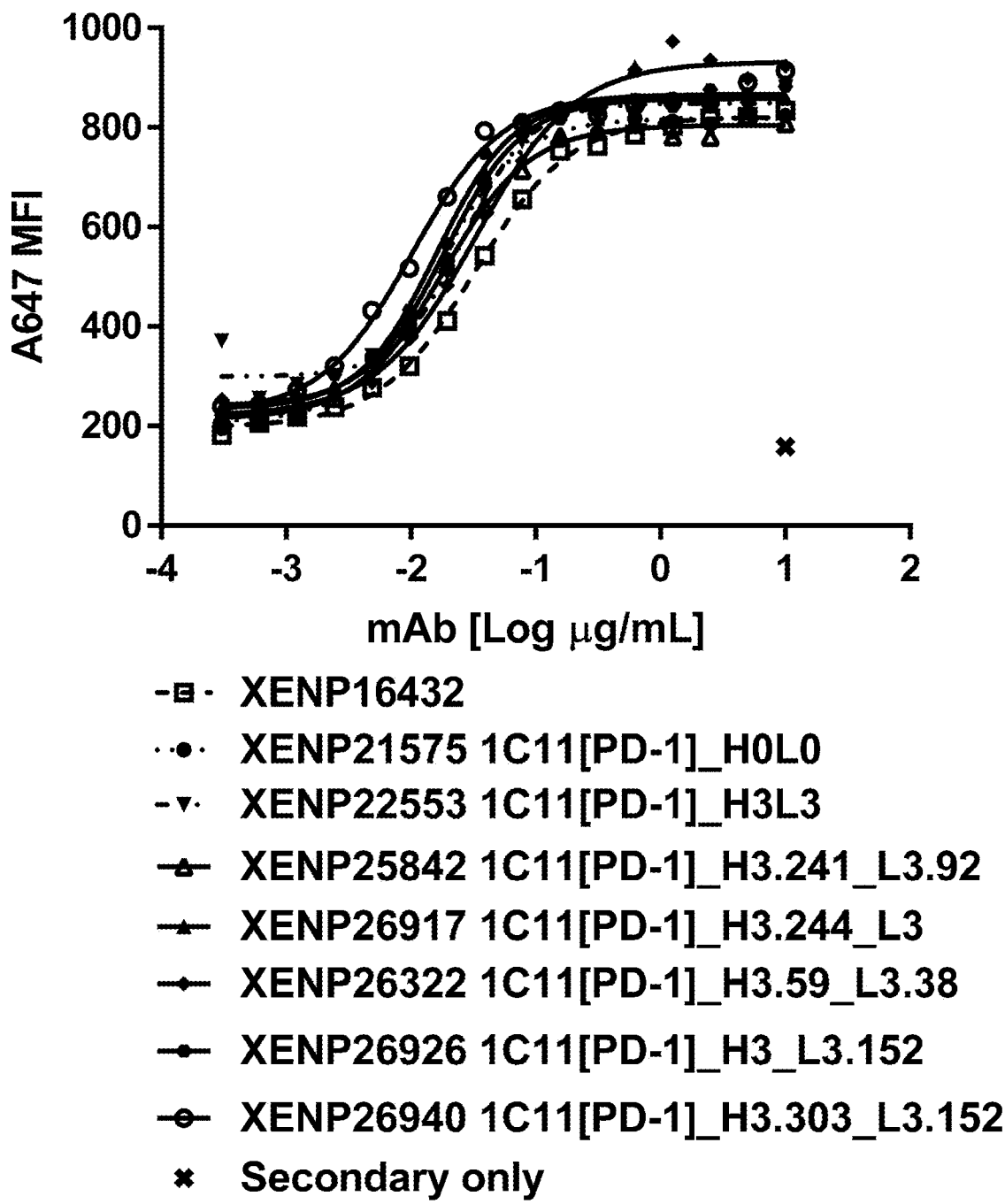

FIG. 27 depicts the binding of affinity optimized anti-PD-1 1C11 variants to SEB-stimulated T cells.

FIG. 28 depicts the blocking of PD-L1 and PD-L2 binding to PD-1 by anti-PD-1 1C11 variants as determined by normalized BLI-response in a tandem epitope binning assay using Octet.

Figure 29:
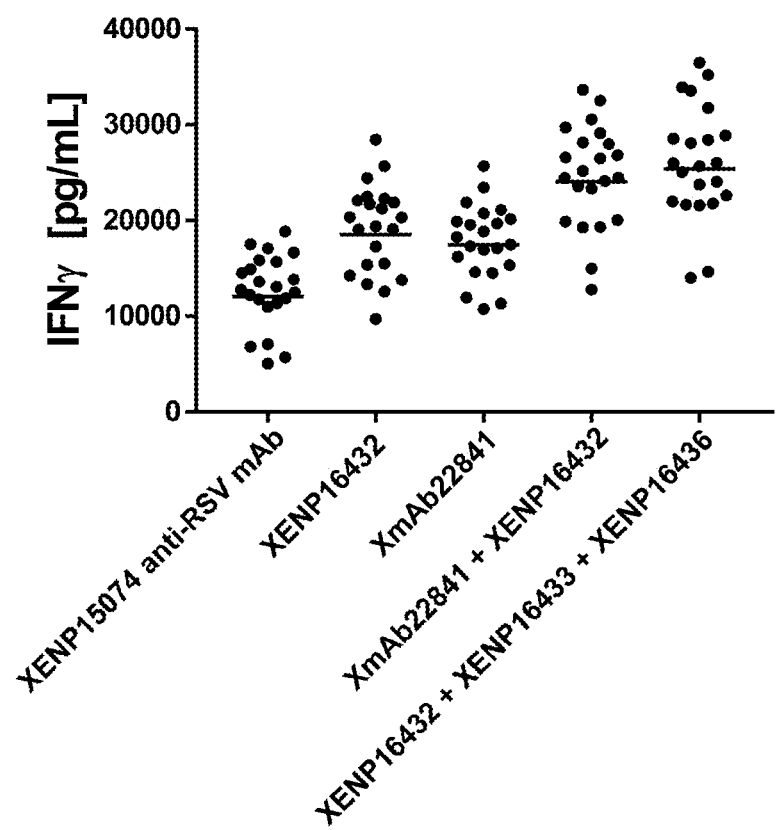

FIG. 29 depicts IFNγ secretion in an SEB-stimulated PBMC assay following incubation with the indicated test articles.

Figure 30:
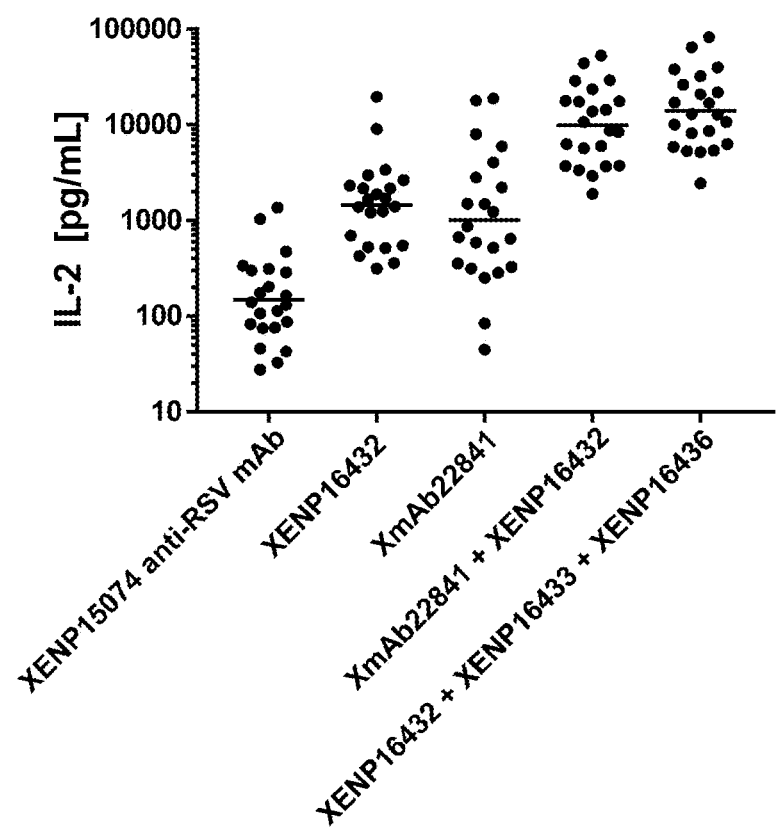

FIG. 30 depicts IFNγ secretion in an SEB-stimulated PBMC assay following incubation with the indicated test articles.

Figure 31:
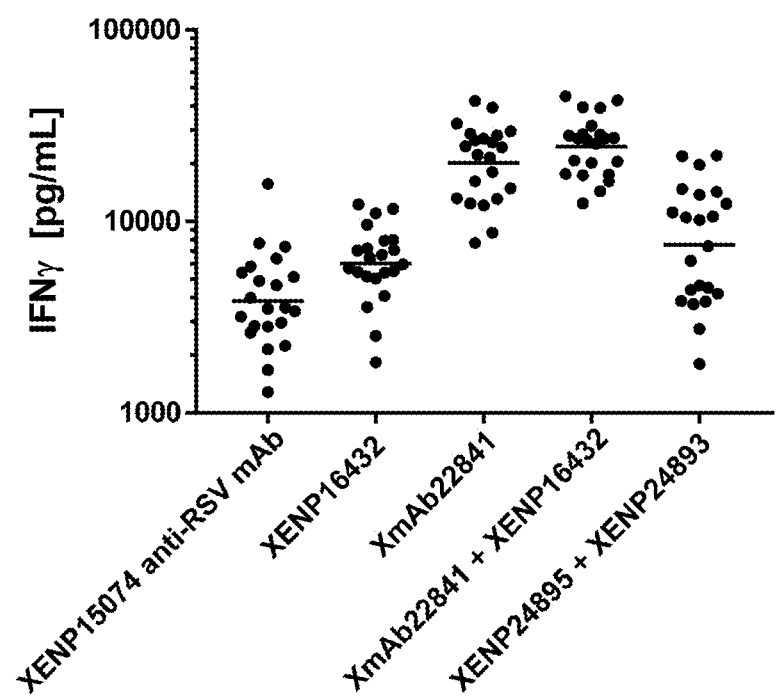

FIG. 31 depicts IFNγ secretion in an MLR assay following incubation with 20 μg/mL of the indicated test articles.

Figure 32:
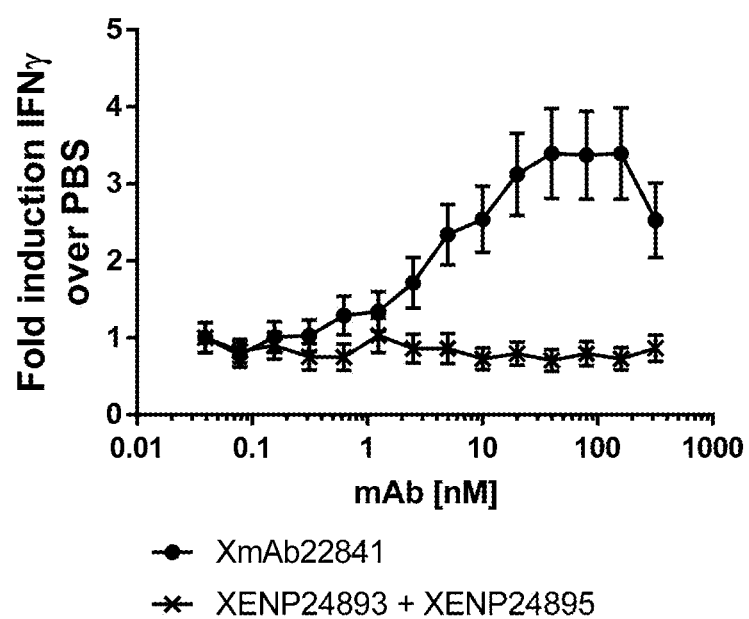

FIG. 32 depicts IFNγ secretion in an MLR assay following incubation with the indicated concentrations of the indicated test articles.

FIG. 33 depicts the sequences for XENP26842, a bivalent anti-PD-1 mAb with an ablation variant (E233P/L234V/L235A/G236de1/S267K, "IgG1_PVA_/S267k") and Xtend variant (M428L/N434S). The CDRs are underlined. As noted herein and is true for every sequence herein containing CDRs, the exact identification of the CDR locations may be slightly different depending on the numbering used as is shown in Table 1, and thus included herein are not only the CDRs that are underlined but also CDRs included within the $V_H$ and $V_L$ domains using other numbering systems. Additionally, each CDR has its own SEQ ID NO: in the sequence listing, and each VH and $V_L$ domain has its own SEQ ID NO: in the sequence listing.

Figure 34:
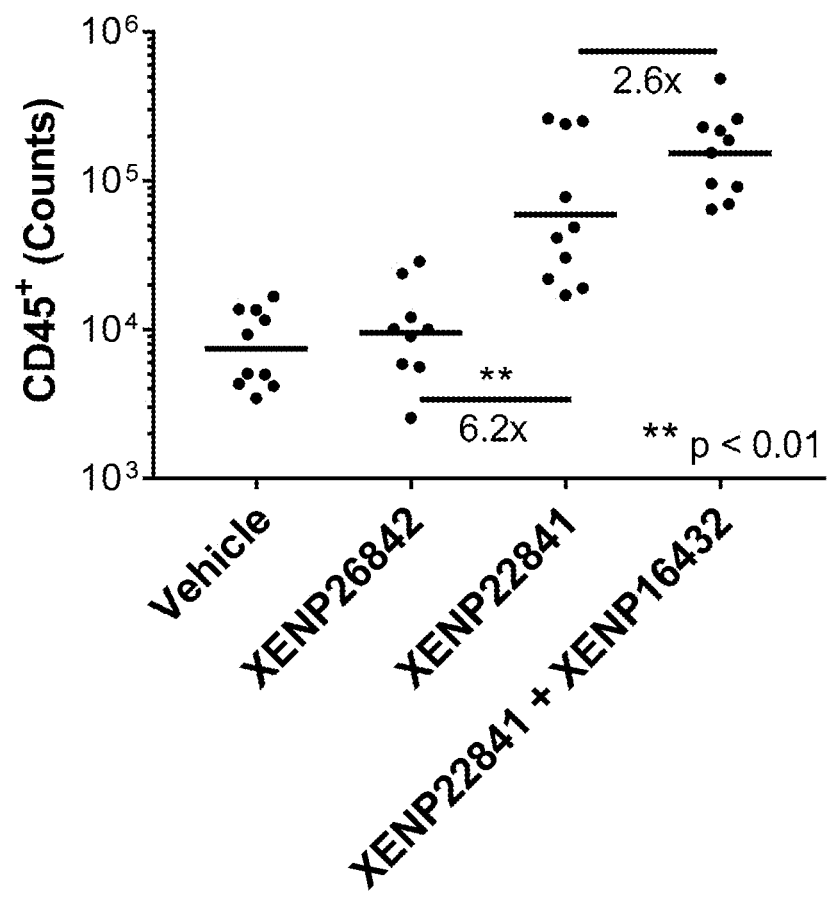

FIG. 34 depicts CD45$^+$ cell counts in whole blood of NSG mice on Day 14 after engraftment with human PBMCs on Day 0 and dosing with indicated test articles on Days 1 and 8.

Figure 35:
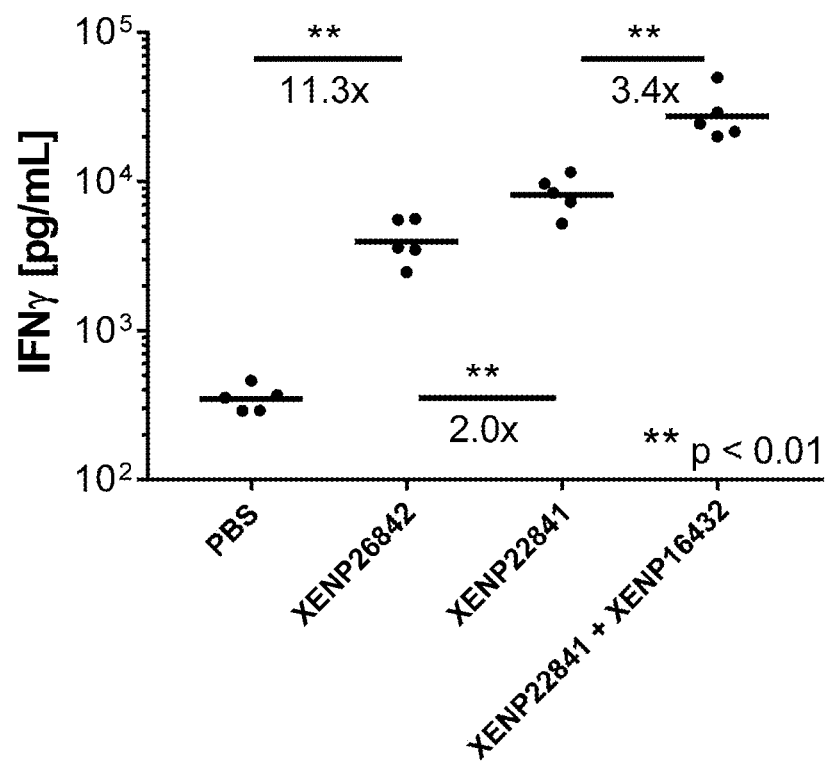

FIG. 35 depicts IFNγ concentration in serum of NSG mice on Day 7 after engraftment with human PBMCs on Day 0 and dosing with indicated test articles on Day 1.

Figure 36A:
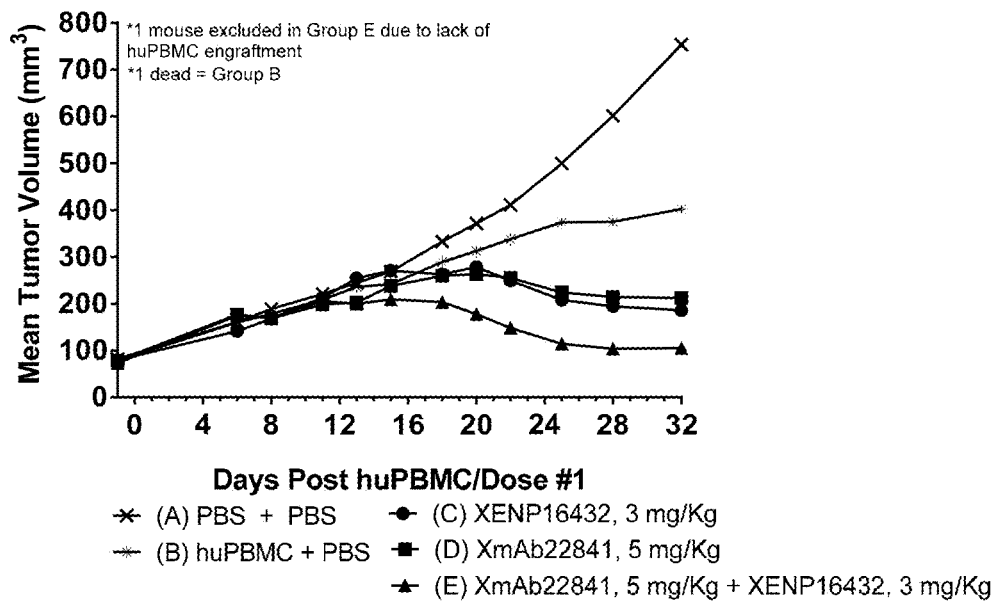
Figure 36B:
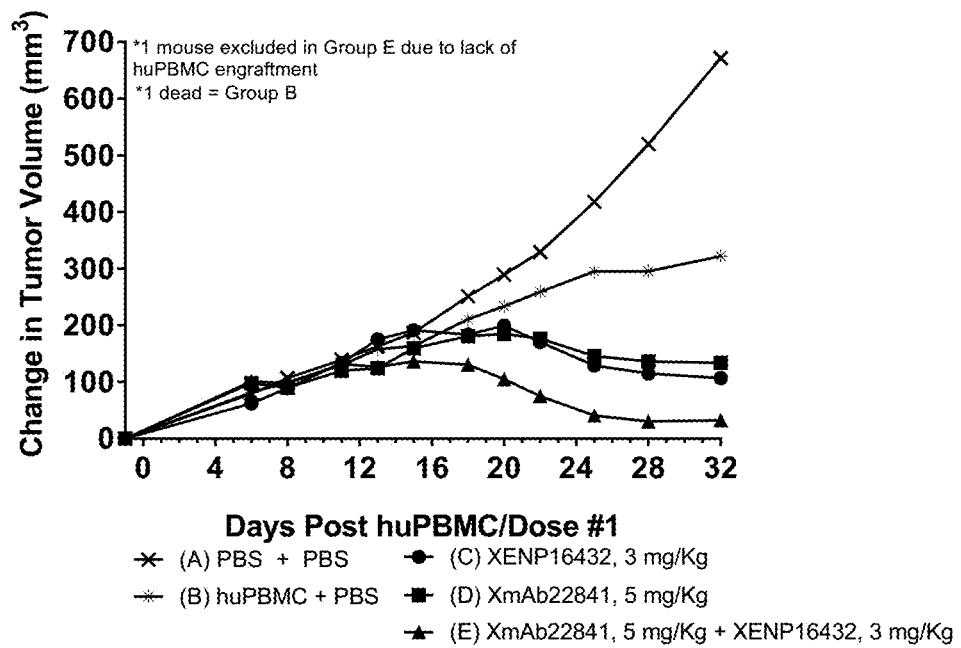
Figure 37A:
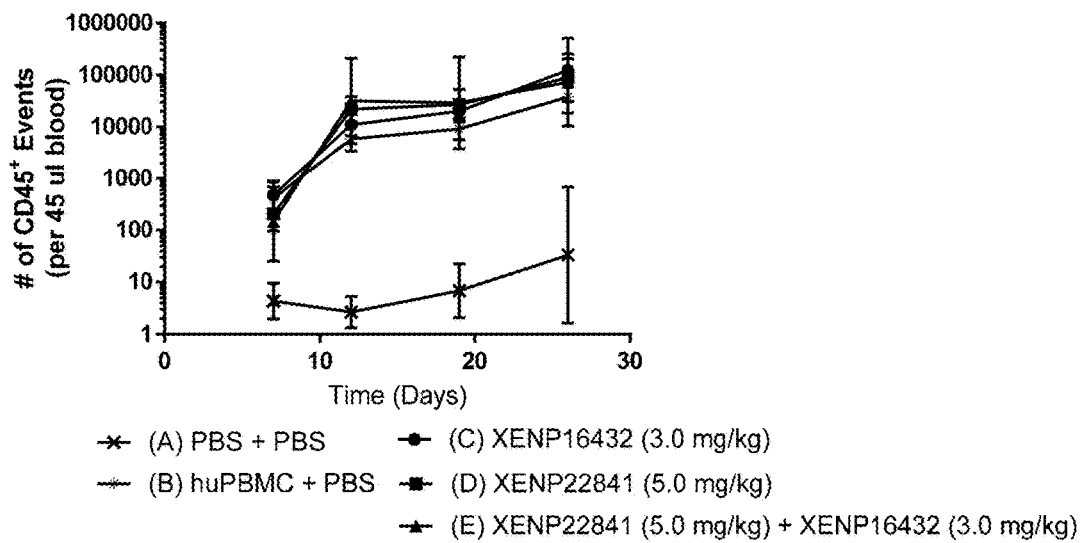
Figure 37B:
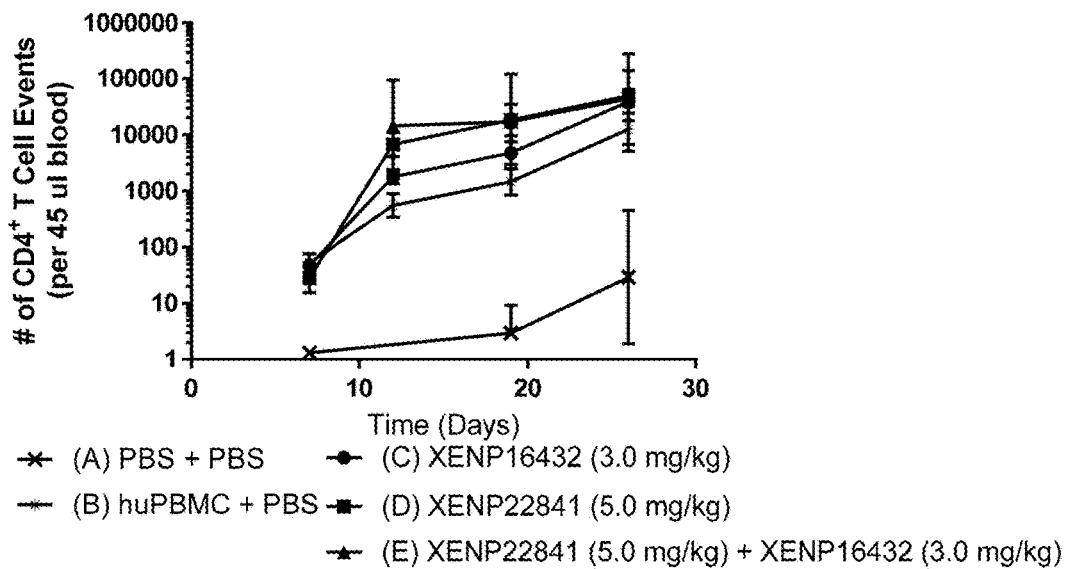
Figure 37C:
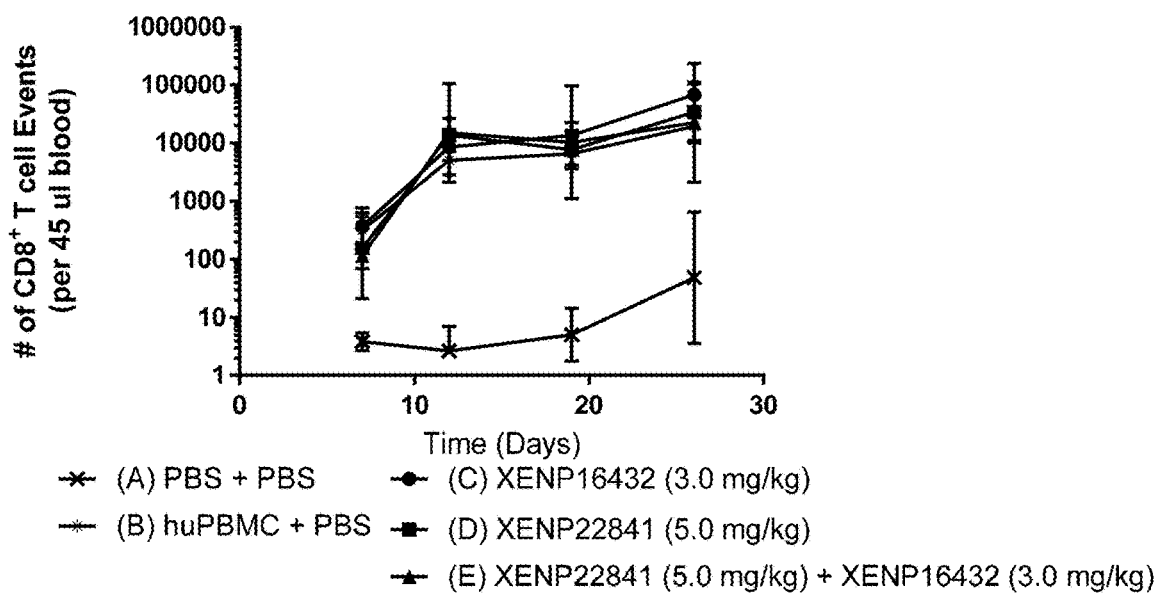
Figure 37D:
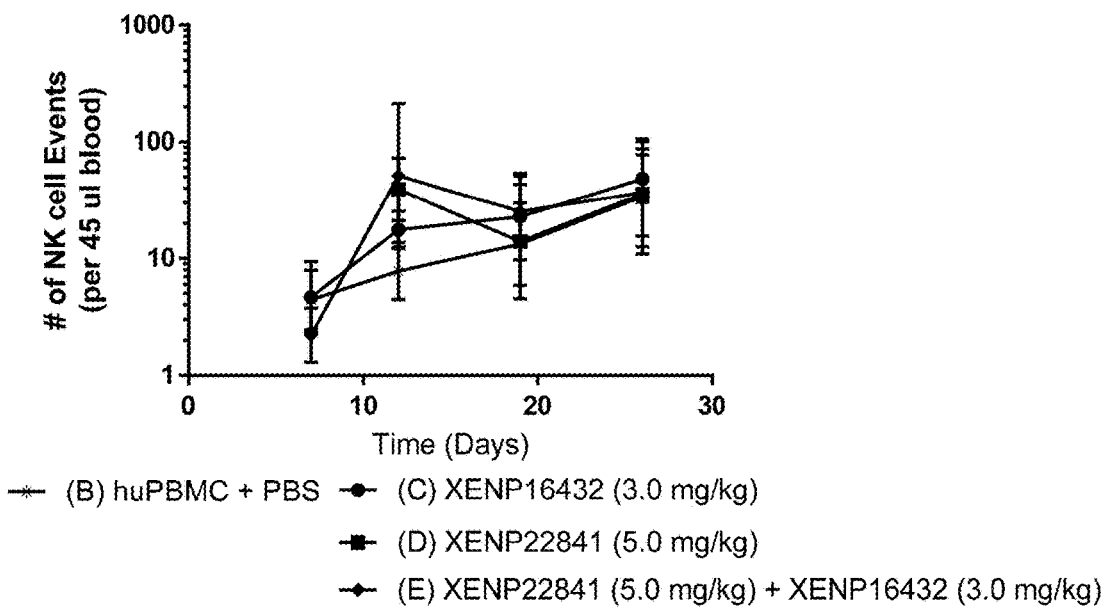

FIGS. 36A and 36B depict A) the mean tumor volume and B) change in tumor volume in NSG mice engrafted with pp65-expressing MCF-7 cells, following engraftment with pp65 reactive huPBMC and treatment with indicated test articles.

FIGS. 37A to 37D depict A) CD45$^+$ cell, B) CD4$^+$ T cell, C) CD8$^+$ T cell, and D) NK cell counts in the whole blood of NSG mice engrafted with pp65-expressing MCF-7 cells following engraftment with pp65 reactive huPBMC and treatment with indicated test articles.

Figure 38:
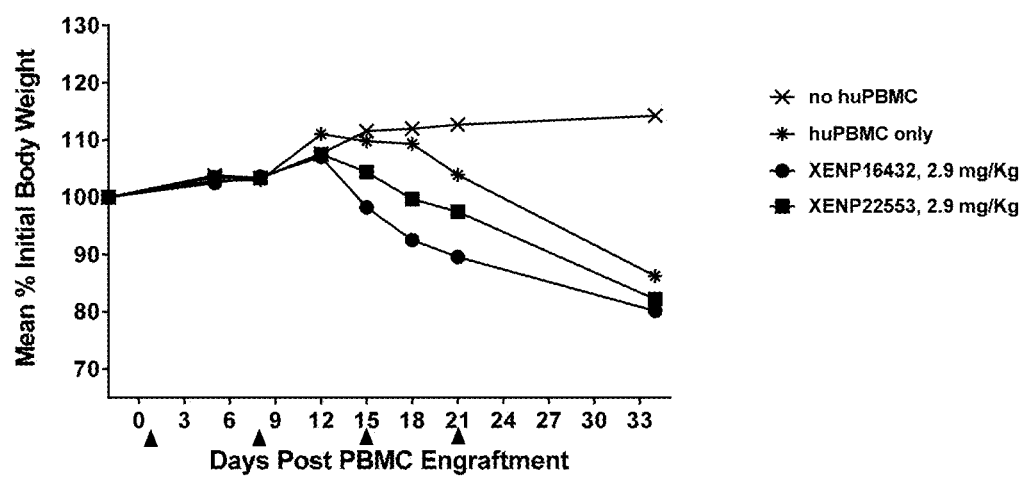

FIG. 38 depicts the change in weight over time (as a percentage of initial body weight) in huPBMC-engrafted NSG mice dosed with the indicated test articles.

Figure 39A:
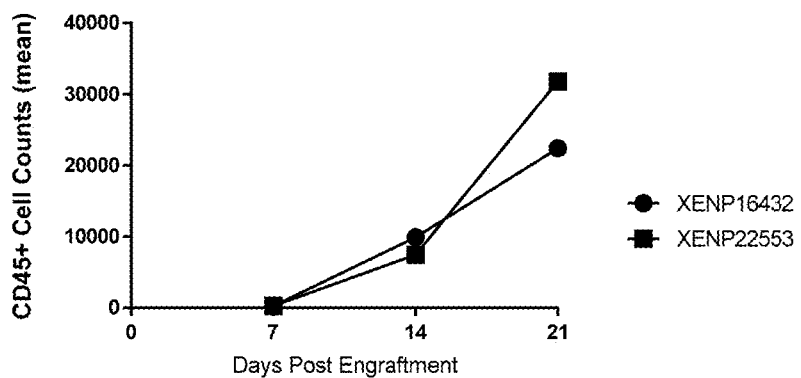
Figure 39B:
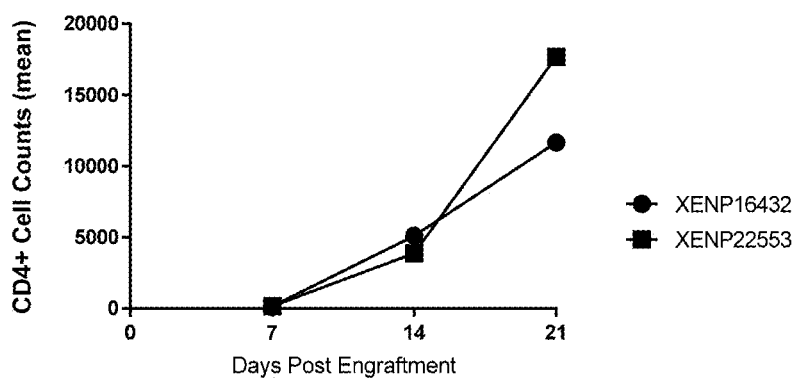
Figure 39C:
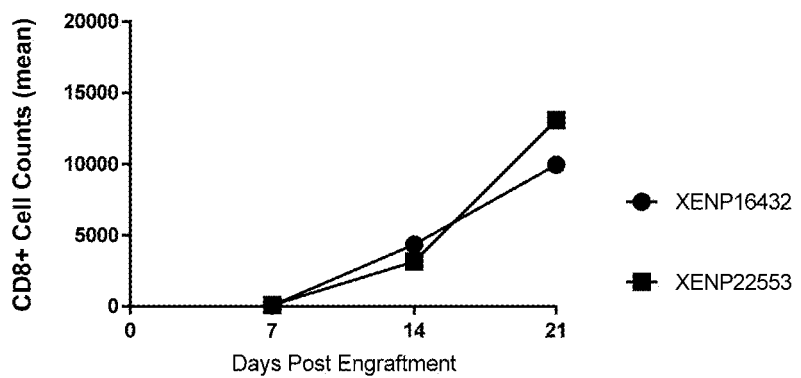

FIGS. 39A to 39C depict A) human CD45$^+$, B) human CD4$^+$ T cell, and C) human CD8$^+$ T cell counts in huPBMC-engrafted NSG mice following dosing with the indicating test articles.

FIGS. 40A to 40BB depict sequences for additional illustrative variant anti-PD-1 mAbs based on done 1C11. The CDRs are underlined, and the slashes indicate the borders of the variable domains. As noted herein and is true for every sequence herein containing CDRs, the exact identification of the CDR locations may be slightly different depending on numbering used as is shown in Table 1, and thus included herein are not only the CDRs that are underlined but also CDRs included within the $V_H$ and $V_L$ domains using other numbering systems. As will be appreciated by those in the art, the $V_H$ and $V_L$ domains can be formatted as Fabs or scFvs. Additionally, these sequences can include the M428L/N434S Xtend mutations. Additionally, each CDR has its own SEQ ID NO: in the sequence listing, and each $V_H$ and $V_L$ domain has its own SEQ ID NO: in the sequence listing.

FIG. 41 depicts the affinity/dissociation constants ($K_D$), association rates ($k_a$), and dissociation rates ($k_d$) of anti-PD-1 1C11 variants for human PD-1 as determined by Octet.

FIG. 42 depicts the affinity/dissociation constants ($K_D$), association rates ($k_a$), and dissociation rates ($k_d$) of anti-PD-1 1C11 variants for human PD-1 as determined by Octet.

FIG. 43 depicts the affinity/dissociation constants ($K_D$), association rates ($k_a$), and dissociation rates ($k_d$) of anti-PD-1 1C11 variants for human PD-1 as determined by Octet.

FIG. 44 depicts the affinity/dissociation constants ($K_D$), association rates ($k_a$), and dissociation rates ($k_d$) of anti-PD-1 1C11 variants for human PD-1 as determined by Octet.

FIG. 45 depicts the affinity/dissociation constants ($K_D$), association rates ($k_a$), and dissociation rates ($k_d$) of anti-PD-1 1C11 variants for human PD-1 and cynomolgus PD-1 as determined by Octet.

Figure 46:
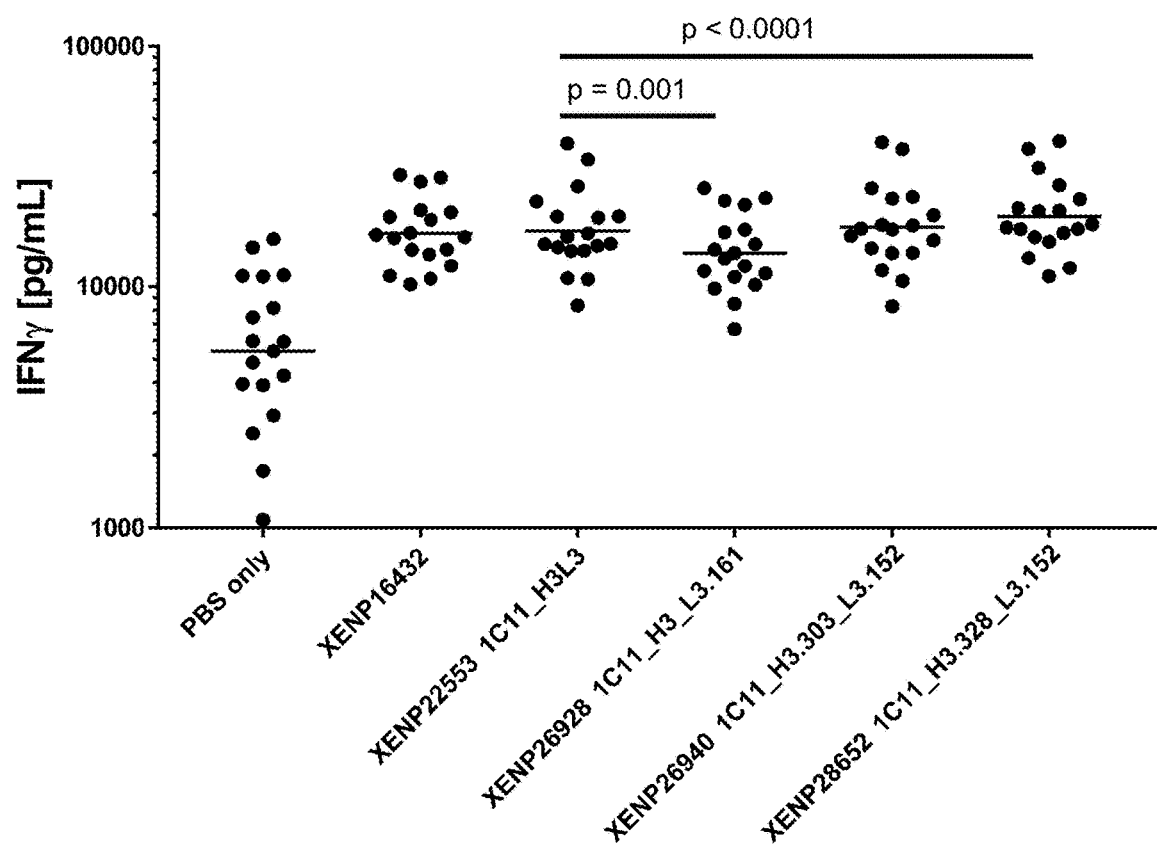

FIG. 46 depicts the induction of IFNγ by indicated 1C11 variants (as well as PBS and anti-PD-1 XENP16432 based on nivolumab as controls) in an SEB-stimulated PBMC assay. p-values are from paired t-test, comparing IFNγ secretion by PBMCs from the same donor.

Figure 47:
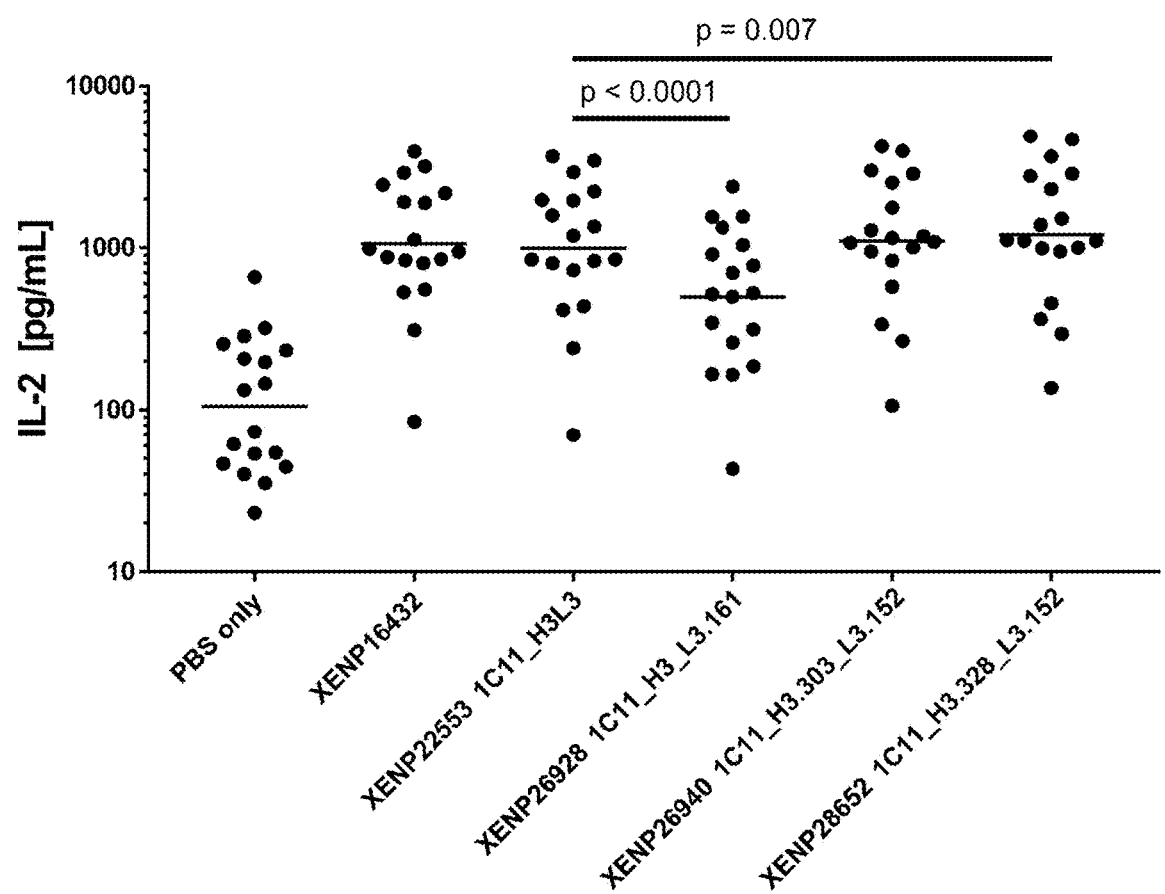

FIG. 47 depicts the induction of IL-2 by indicated 1C11 variants (as well as PBS and anti-PD-1 XENP16432 based on nivolumab as controls) in an SEB-stimulated PBMC assay. p-values are from paired t-test, comparing IL-2 secretion by PBMCs from the same donor.

Figure 48:
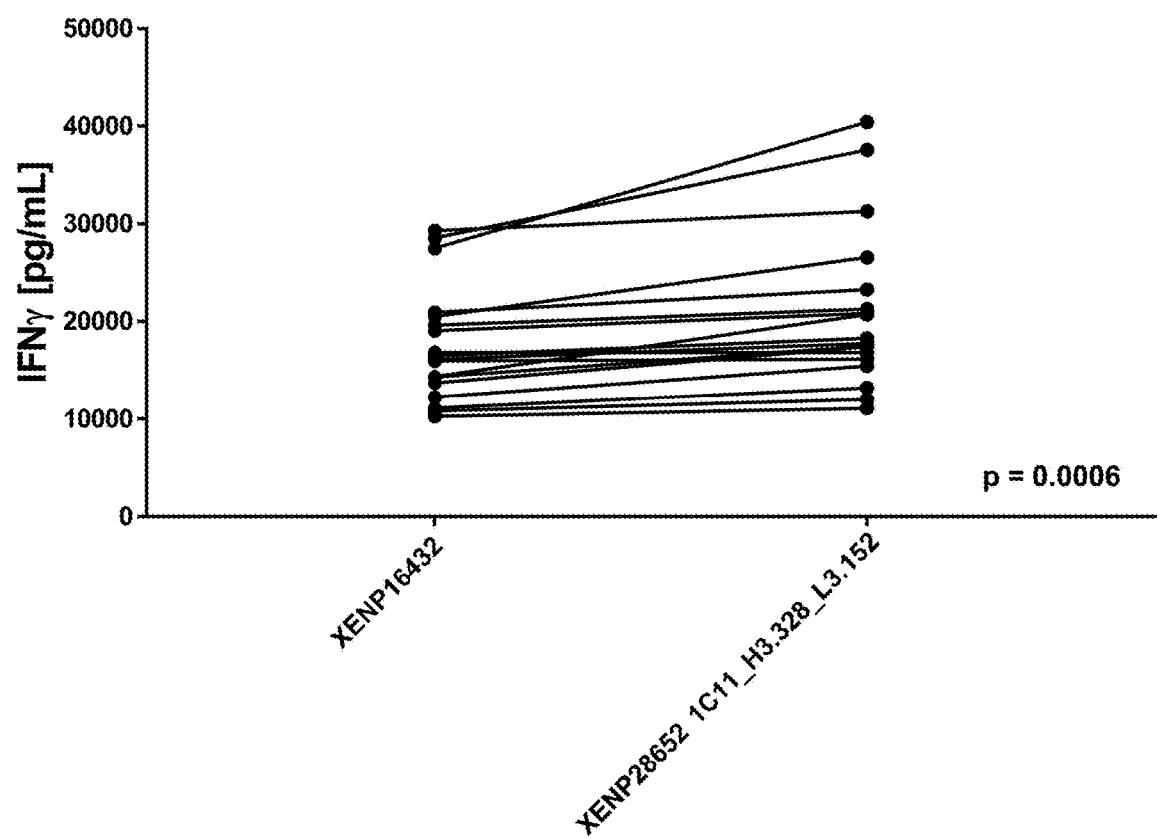

FIG. 48 depicts the induction of IFNγ by indicated anti-PD-1 mAb XENP16432 based on nivolumab and XENP28652 in an SEB-stimulated PBMC assay. p-values are from paired t-test, comparing IFNγ secretion by PBMCs from the same donor.

FIGS. 49A to 49KK show the sequences of a number of heterodimeric antibodies of the present invention in the "bottle opener" format, named using "XENCS" numbering. Three polypeptide chains are shown for each ("Fab chain, scFv chain and light chain"), with the CDRs underlined, linkers double underlined, and the junction between domains indicated by a "/". Each of these has its own sequence and thus identifier.

FIGS. 50A to 50E show the sequences of several useful "bottle opener" format "skeletons", with the Fvs of the scFv side directed to several particular anti-PD-1 ABDs, but without the Fv sequences for the "Fab" side. As will be appreciated by those in the art and outlined below, these "skeleton" sequences can be used with any Fab sequences outlined herein and contained within the sequence listing (e.g. a $V_H$ attached to the "Fab side heavy chain" or "Fab monomer" and a $V_L$ attached to the constant light chain). It should also be noted that these bottle opener skeleton sequences find use in the Central-scFv format of FIG. 1F (sometimes also referred to as the "2+1" format), with the addition of a second $V_H$ and CH1 domain as described herein. The Fab chain of each starts with a "/" delineating the beginning of the CH1 domain, such that a $V_H$ domain from an ABD as described herein is N-terminally fused to form a full length heavy chain, with the corresponding $V_L$ domain from the ABD being N-terminally fused to the '/" delineating the beginning of the CL domain in the light chain, such that a Fab is formed with the Fab chain and the light chain. The scFv chain is outlined for particular anti-PD-1 ABDs, with the CDRs underlined, the scFv linker double underlined, and "/" to indicate the junctions of domains. BO skeletons 1 to 4 (XENCS556 to 559) are identical to BO skeletons 5-8 (XENCS560 to 563) except the later include the 428L/434S "XTend®" Fc variants.

Figure 51:
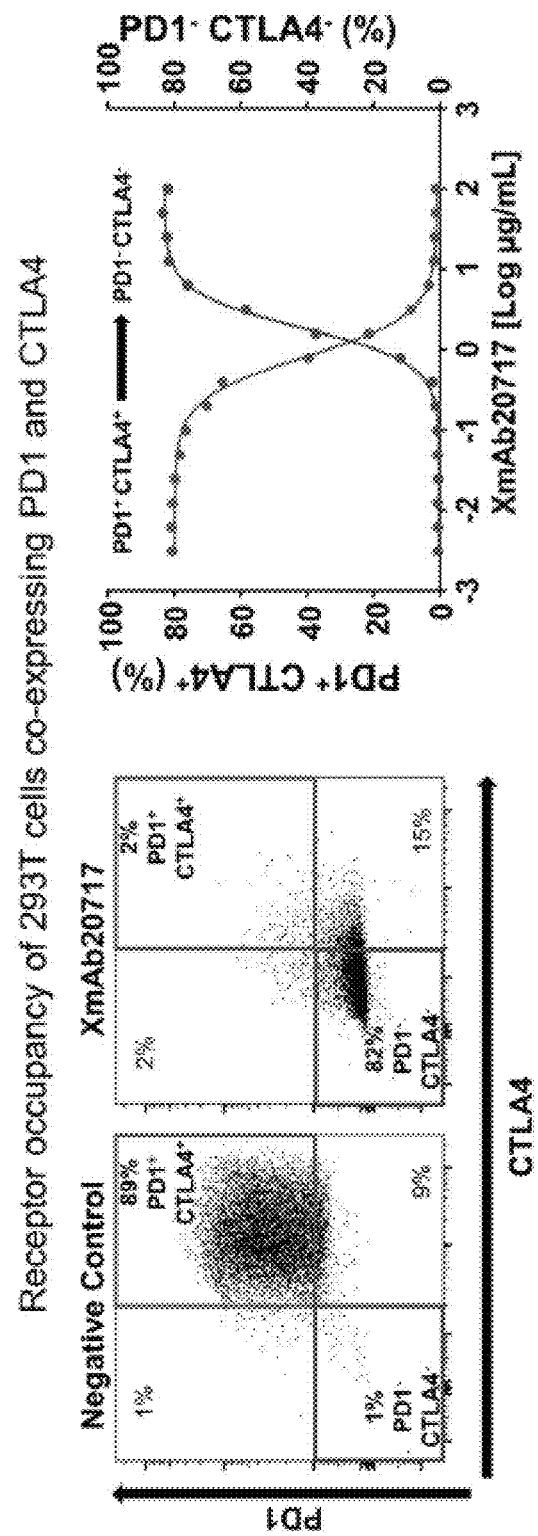

FIG. 51 shows that subject bispecific antibody XmAb20717 (anti-CTLA-4 x anti-PD-1) selectively target 293 T Cells that co-express PD1 and CTLA4.

Figure 52:
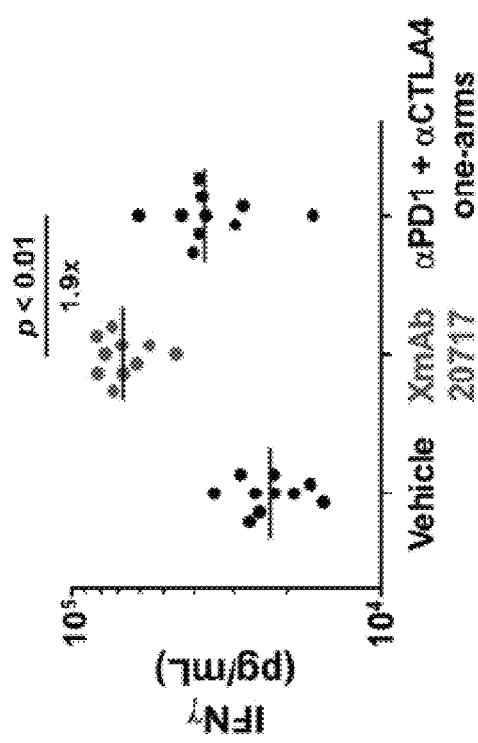

FIG. 52 shows that the binding avidity of XmAB20717 contributes to T cell activiation. In particular, IFNγ levels on Day 14 are shown after human PBMCs were engrated into NSG mice on Day 0 followed by dosing with the indicated test articles on Day 1.

Figure 53:
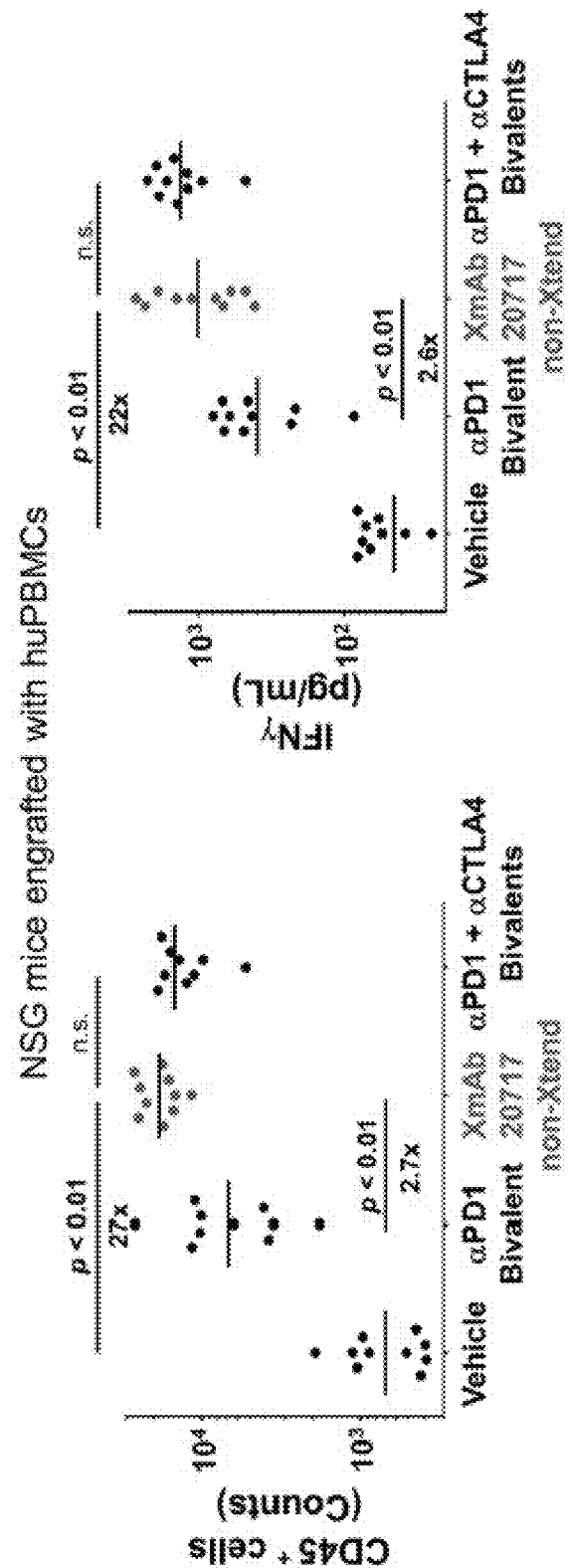

FIG. 53 shows that XmAB20717 promotes superior T cell activation compared to an anti-PD1 bivalent antibody. In particular, CD45+ cell counts and IFNγ levels on Day 14 are shown after human PBMCs were engrated into NSG mice on Day 0 followed by dosing with the indicated test articles on Day 1.

Figure 54:
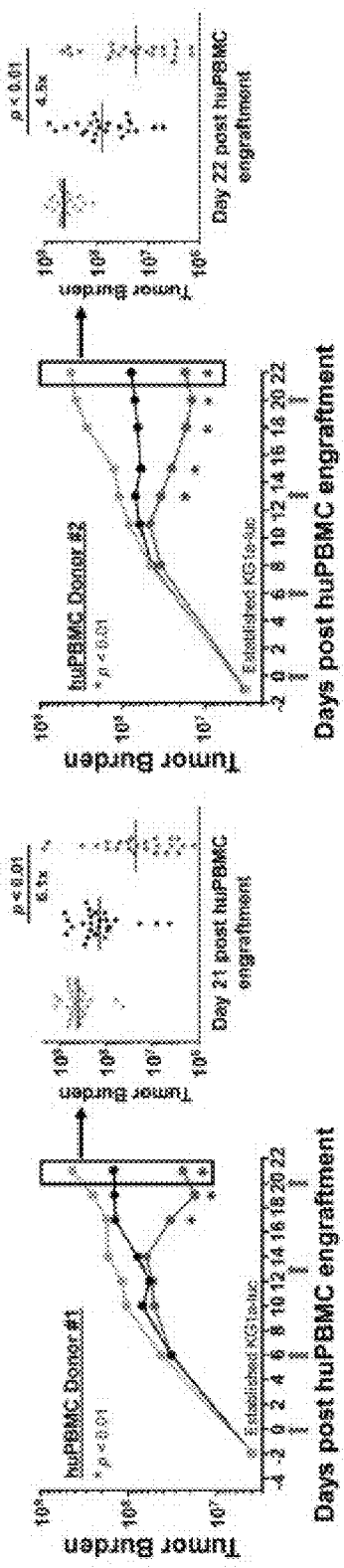

FIG. 54 is graphs showing that XmAb20717 enhances allogeneic anti-tumor responses in mice. NSG mice were engrafted with KG1a-luc followed by engaftment with huPBMCs. Tumor burden presented is derived from the geometric mean flux acquired by IVIS imaging of KG1a-luc.

Figure 55:
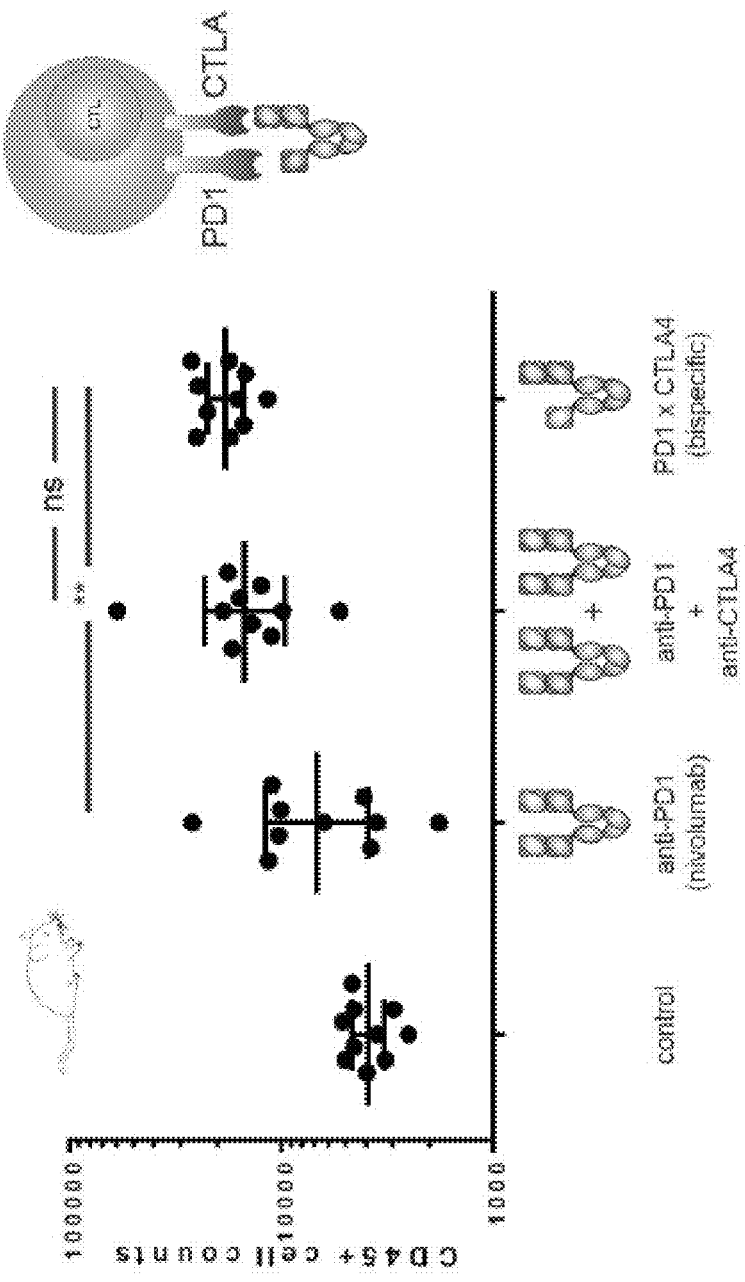

FIG. 55 is a graph showing that PD1 x CTLA4 bispecific antibodies are highly active in a mouse model for checkpoint blockade, as measured in CD45+ cell counts.

Figure 56:
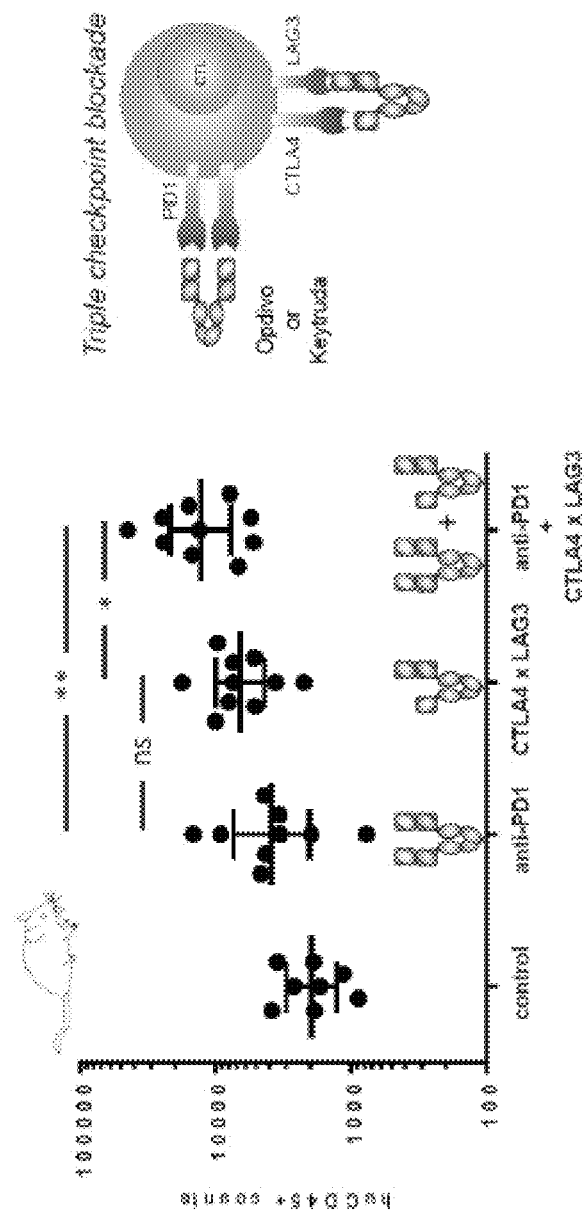

FIG. 56 is a graph showing that CTLA4 x LAG3 bispecific is active and combines with anti-PD-1 for triple blockade for a mouse model for checkpoint blockade.

Figure 57A:
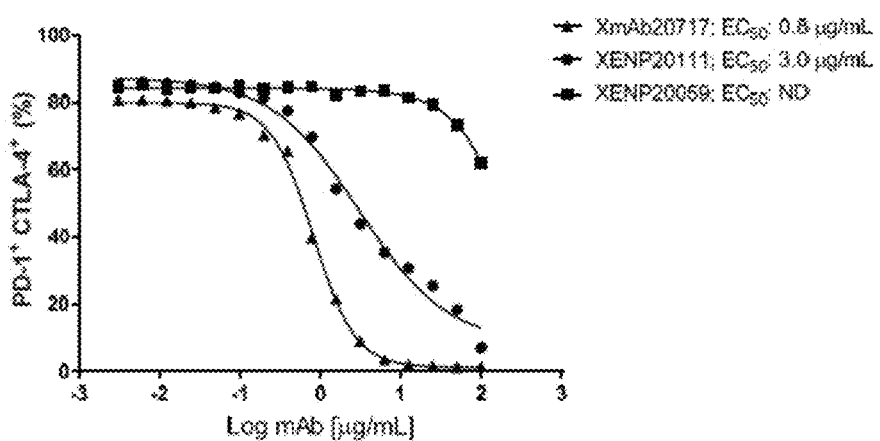
Figure 57B:
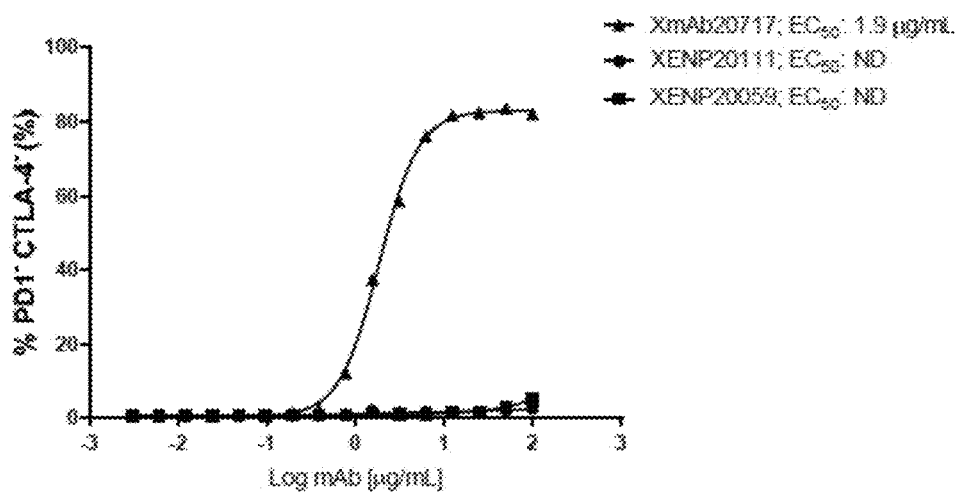

FIGS. 57A and 57B depict checkpoint receptor occupancy by the indicated test articles as indicated by percentage of populations of HEK293T cells expressing both CTLA-4 and PD-1 with unoccupied CTLA-4 and/or LAG-3 receptors as shown by staining.

Figure 58:
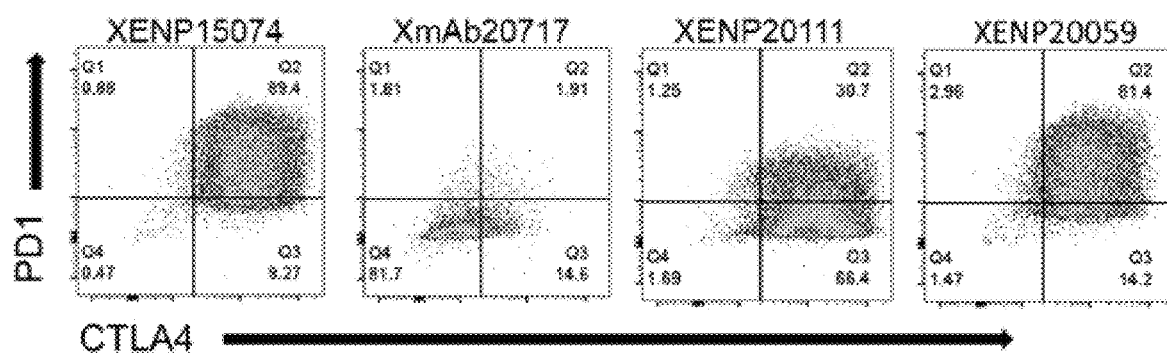

FIG. 58 shows FACS scatter plots depicting populations of (Q1) CTLA-4-PD-1+, (Q2) CTLA-4+PD-1+, (Q3) CTLA-4−PD-1+, and (Q4) CTLA-4−PD-1− cells following treatment with the indicated test articles.

Figure 59A:
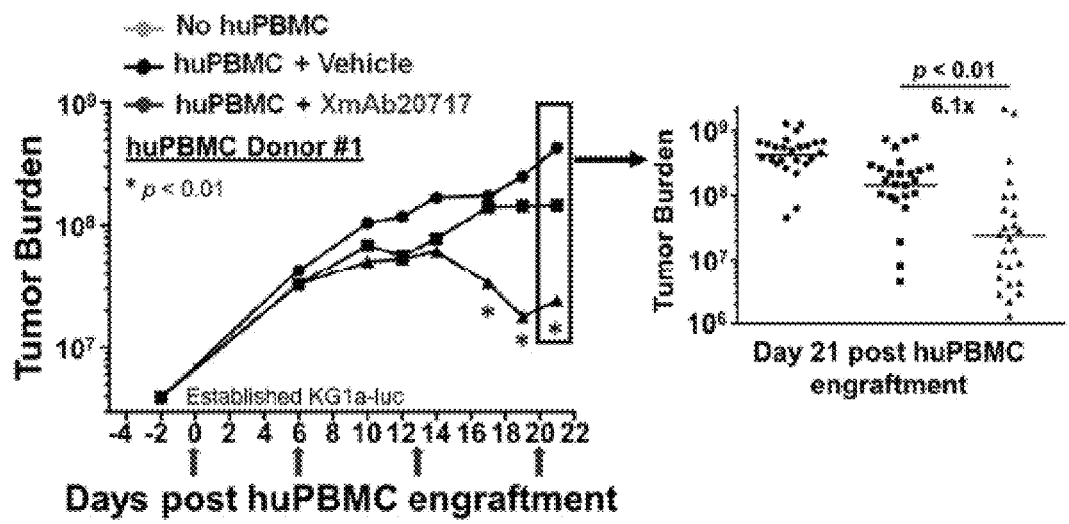
Figure 59B:
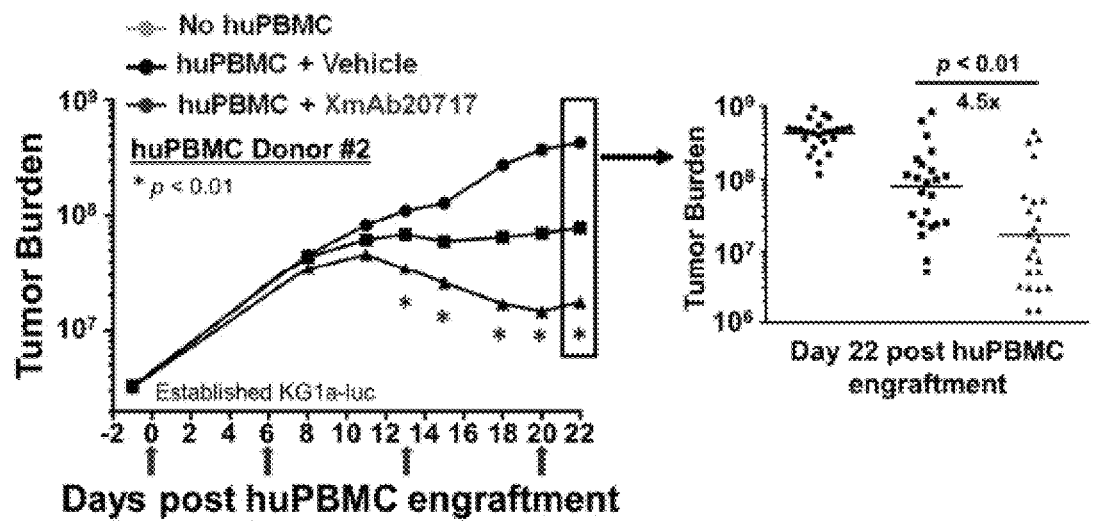

FIGS. 59A and 59B depict tumor burden (derived from the geometric mean flux acquired by IVIS imaging of KG1a-luc) in NSG mice engrafted with KG1a-luc followed by engraftment with huPBMCs following treatment with XmAb20717.

Figure 60:
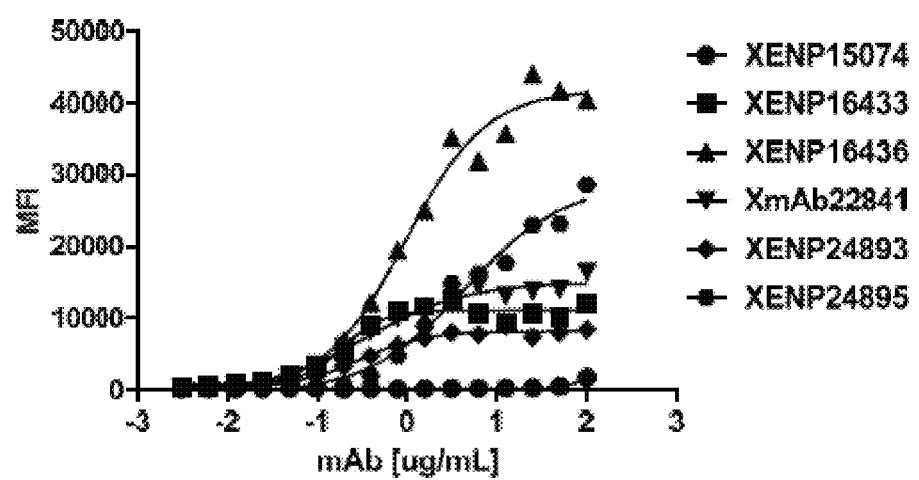
Figure 61A:
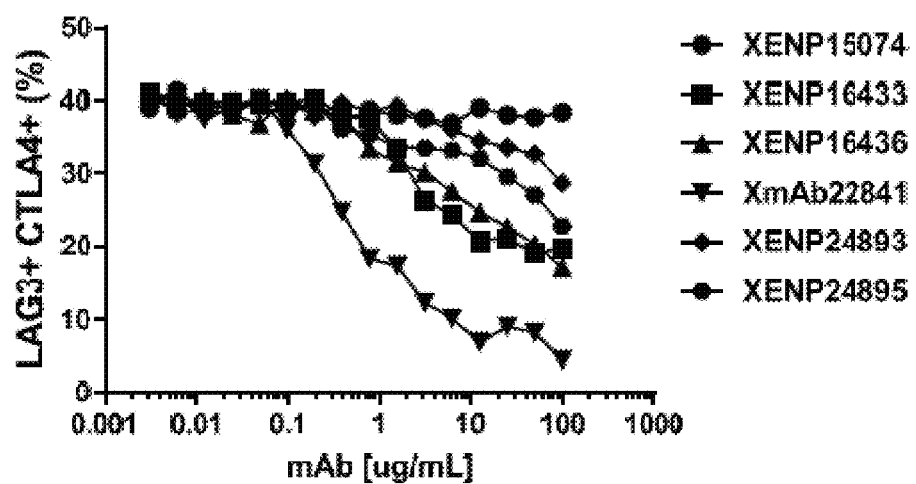
Figure 61B:
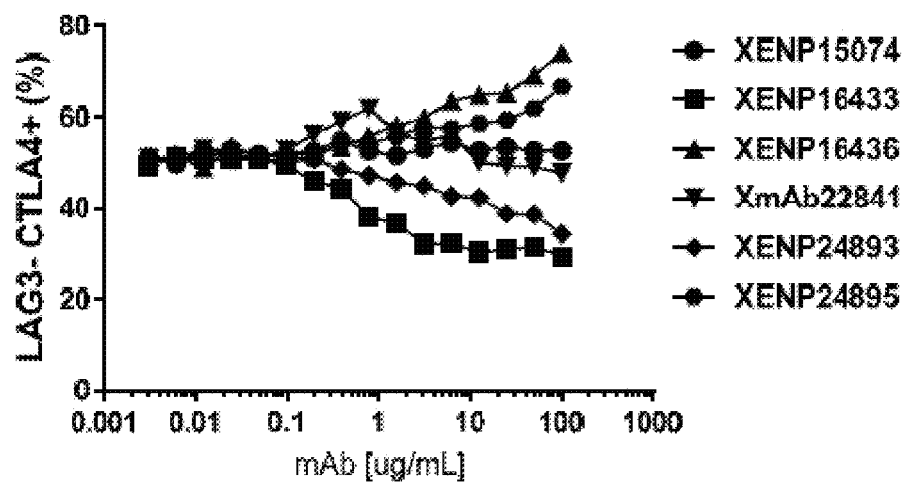
Figure 61C:
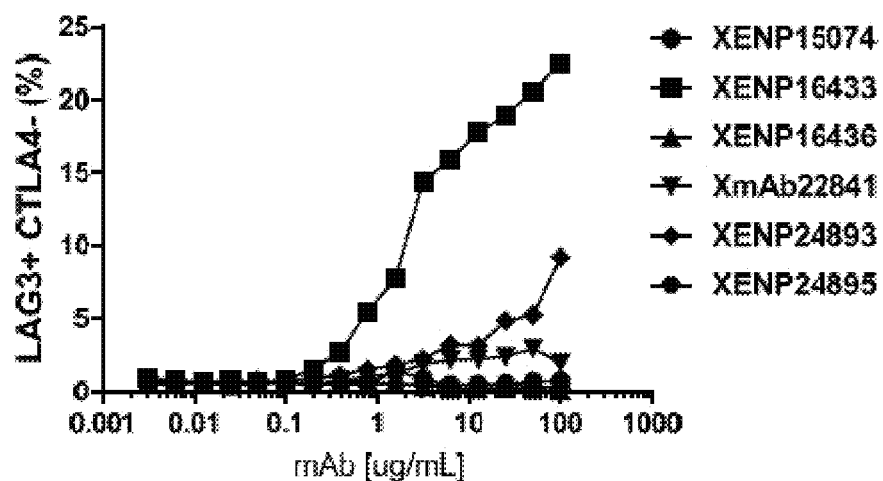
Figure 61D:
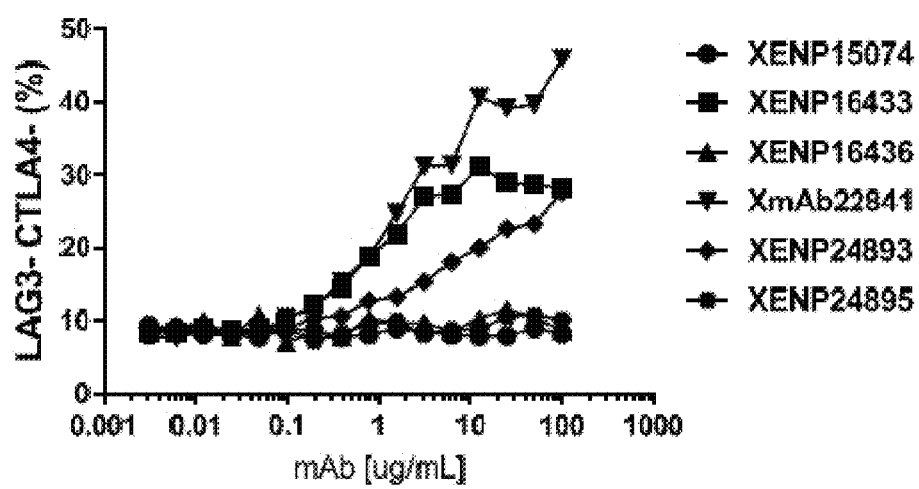

FIG. 60 depicts the binding of XmAb22841 to HEK293T cells expressing CTLA-4 and LAG-3.

FIGS. 61A to 61D depict checkpoint receptor occupancy by the indicated test articles as indicated by percentage of populations of HEK293T cells expressing both CTLA-4 and LAG-3 with unoccupied CTLA-4 and/or LAG-3 receptors as shown by staining.

Figure 62A:
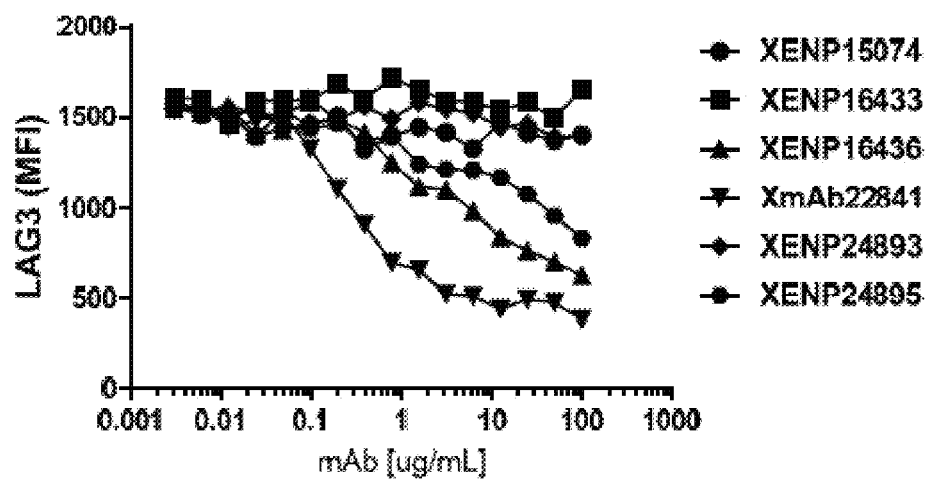
Figure 62B:
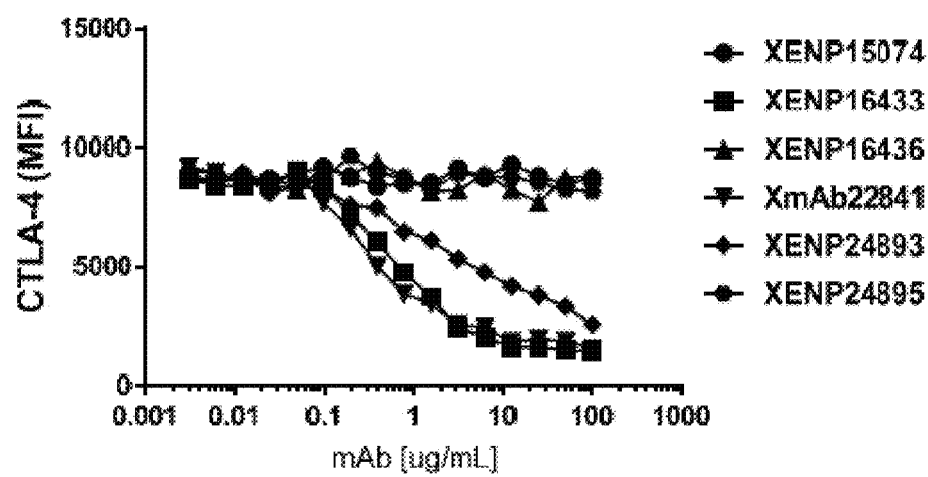
Figure 63A:
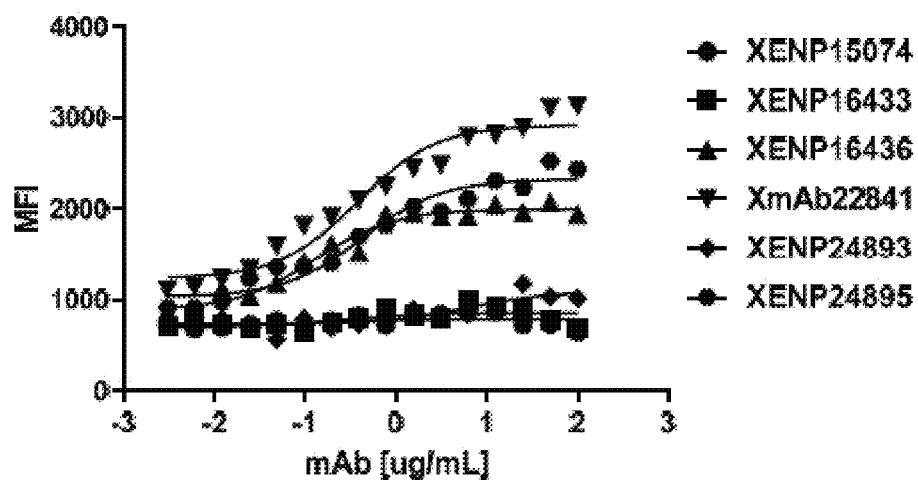
Figure 63B:
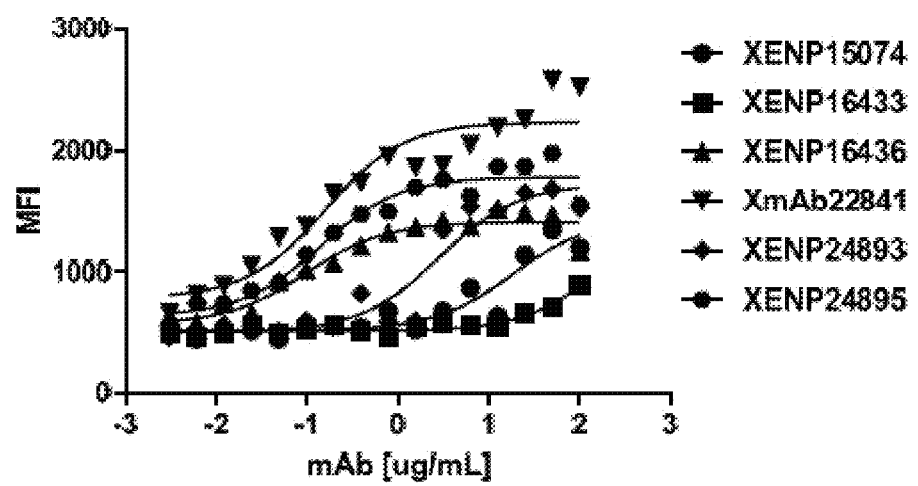
Figure 63C:
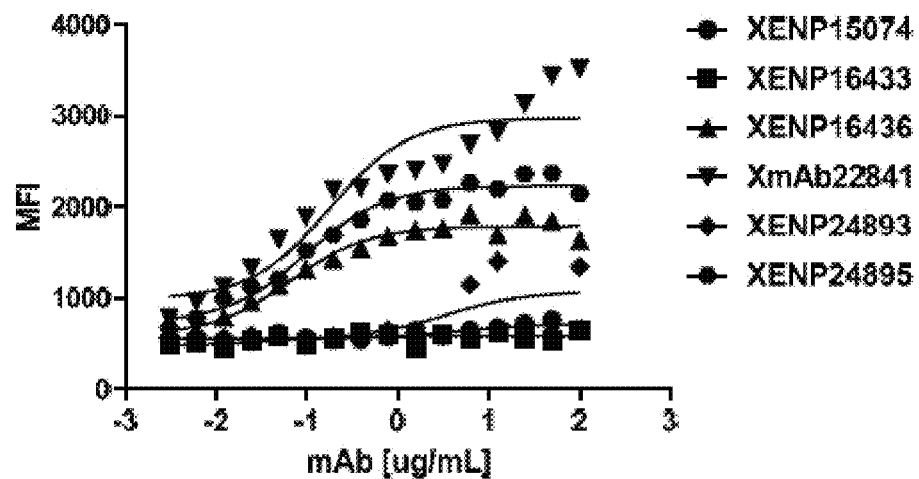
Figure 63D:
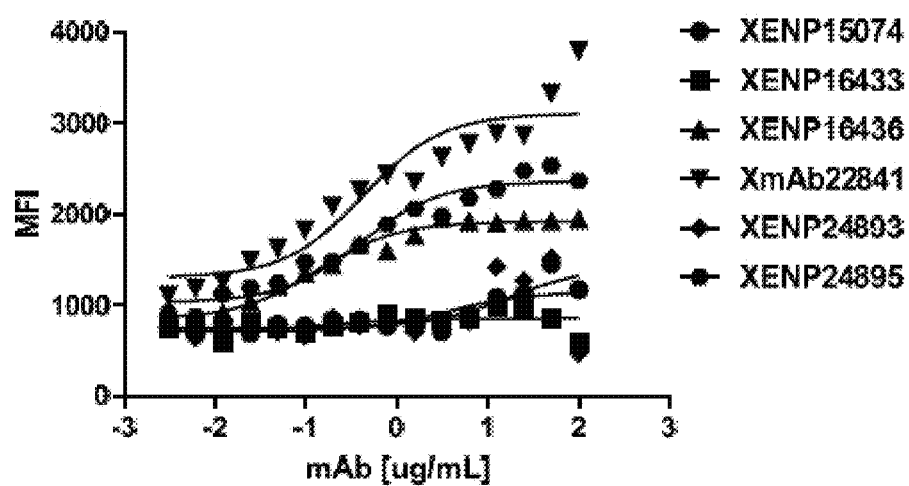
Figure 63E:
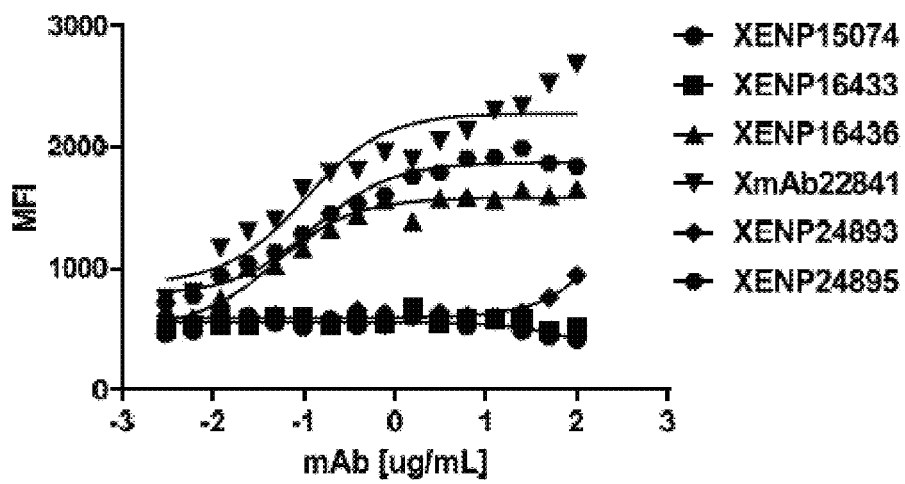
Figure 63F:
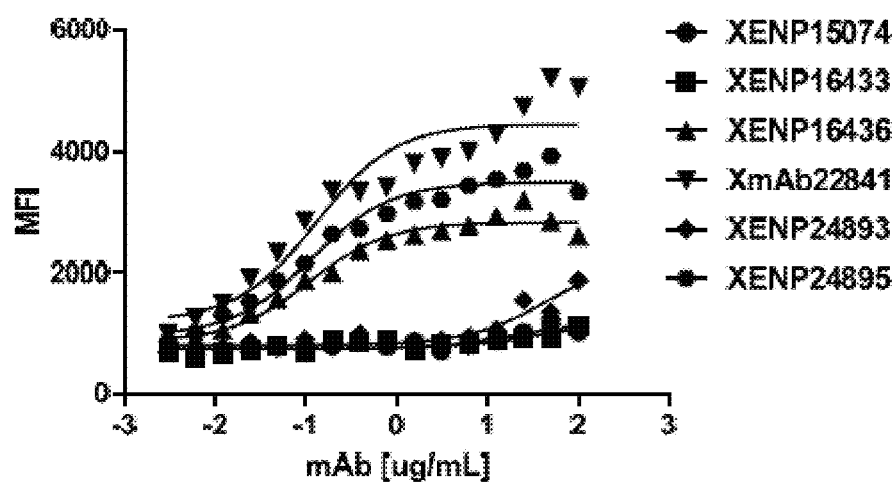

FIGS. 62A and 62B show the amount of unoccupied A) LAG-3 and B) CTLA-4 receptors on HEK293T cells expressing both CTLA-4 and LAG-3 following treatment with the indicated test articles.

FIGS. 63A to 63F depict binding of the indicated test articles to SEB-stimulated T cells from 6 separate PBMC donors (A-F).

Figure 64:
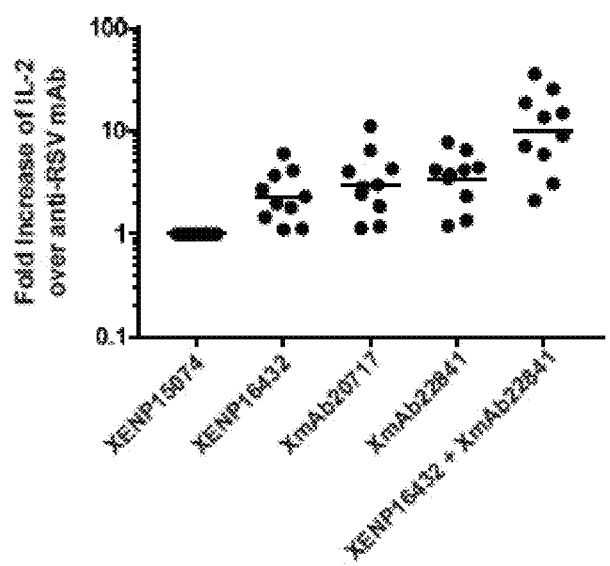

FIG. 64 depicts fold increase in IL-2 release by SEB-stimulated T cells following treatment with XENP16432, XmAb20717, XmAb22841, and XmAb22841 in combination with XENP16432 over treatment with anti-RSV mAb (XENP15074).

Figure 65:
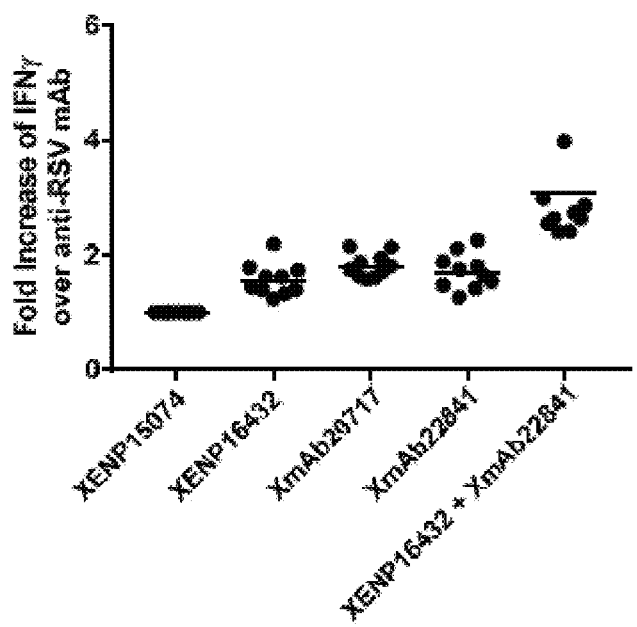

FIG. 65 depicts fold increase in IFNγ release by SEB-stimulated T cells following treatment with XENP16432, XmAb20717, XmAb22841, and XmAb22841 in combination with XENP16432 over treatment with anti-RSV mAb (XENP15074).

Figure 66:
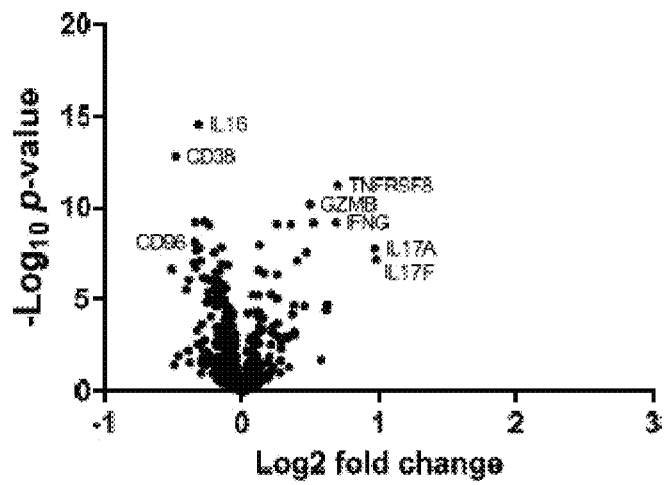

FIG. 66 depicts fold change (x-axis) in expression of immune-related genes by SEB-stimulated T cells following treatment with anti-PD-1 mAb (XENP16432) over treatment with anti-RSV mAb (XENP15074). The y-axis depicts the significance.

Figure 67:
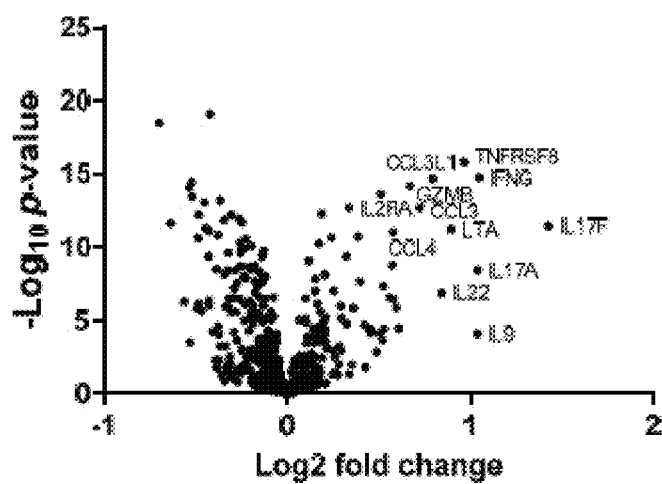

FIG. 67 depicts fold change (x-axis) in expression of immune-related genes by SEB-stimulated T cells following treatment with XmAb20717 over treatment with anti-RSV mAb (XENP15074).

Figure 68:
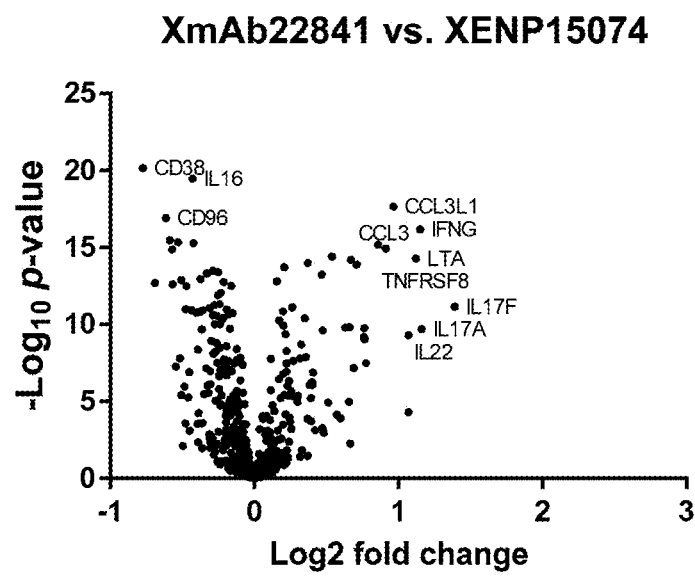

FIG. 68 depicts fold change (x-axis) in expression of immune-related genes by SEB-stimulated T cells following treatment with XmAb22841 over treatment with anti-RSV mAb (XENP15074).

Figure 69:
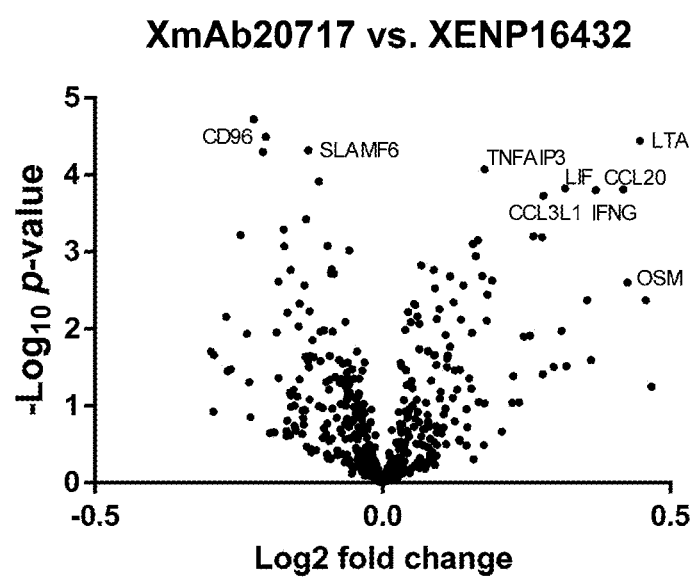

FIG. 69 depicts fold change (x-axis) in expression of immune-related genes by SEB-stimulated T cells following treatment with XmAb20717 over treatment with anti-PD-1 mAb (XENP16432).

Figure 70:
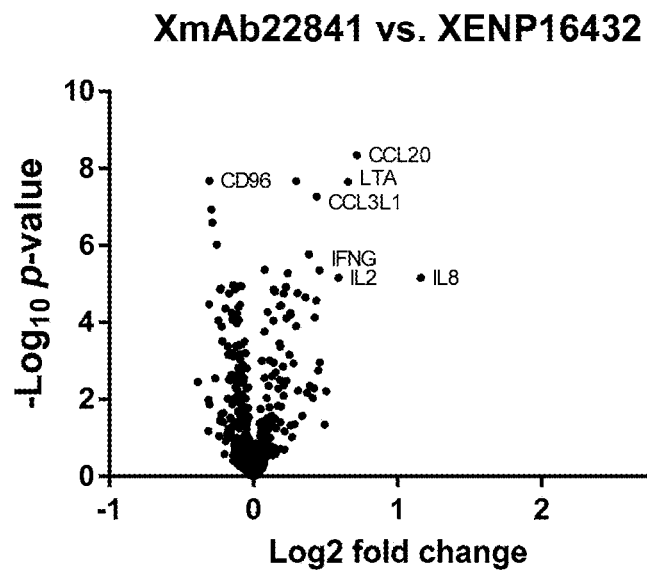

FIG. 70 depicts fold change (x-axis) in expression of immune-related genes by SEB-stimulated T cells following treatment with XmAb22841 over treatment with anti-PD-1 mAb (XENP16432).

Figure 71:
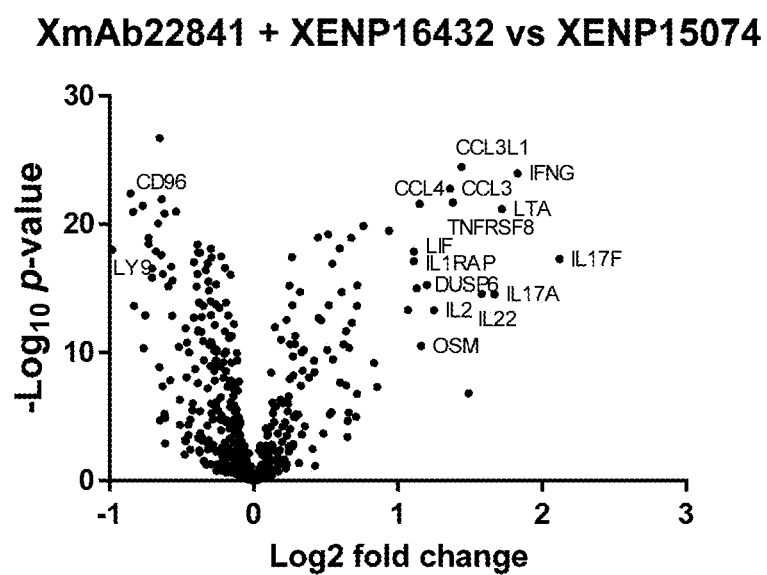

FIG. 71 depicts fold change (x-axis) in expression of immune-related genes by SEB-stimulated T cells following treatment with XmAb22841 in combination with anti-PD-1 mAb (XENP16432) over treatment with anti-RSV mAb (XENP15074).

Figure 72:
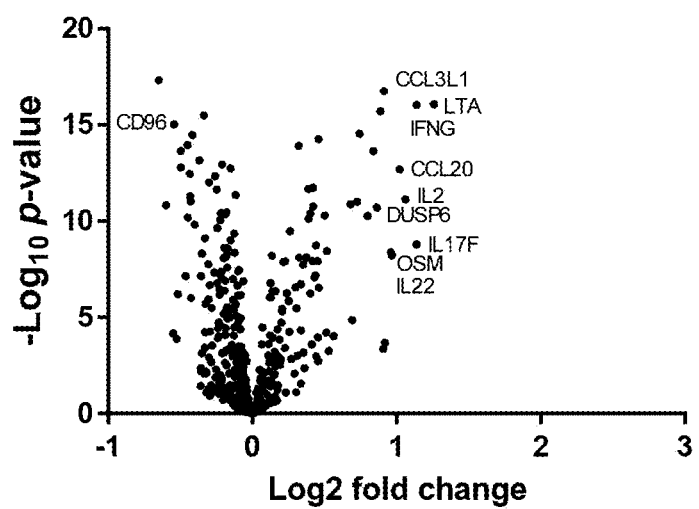

FIG. 72 depicts fold change (x-axis) in expression of immune-related genes by SEB-stimulated T cells following treatment with XmAb22841 in combination with anti-PD-1 mAb (XENP16432) over treatment with anti-PD-1 mAb (XENP16432) alone.

FIG. 73 depicts the sequence for an anti-RSV antibody. It is important to note that these sequences were generated based on human IgG1, with an ablation variant (E233P/L234V/L235A/G236del/S267K, "IgG1_PVA_/S267k"). The CDRs are underlined. As noted herein and is true for every sequence herein containing CDRs, the exact identification of the CDR locations may be slightly different depending on the numbering used as is shown in Table 1, and thus included herein are not only the CDRs that are underlined but also CDRs included within the VH and VL domains using other numbering systems.

FIG. 74 depicts the sequences for an anti-PD-1 antibody with the variable regions from nivolumab. It is important to note that these sequences were generated based on human IgG1, with an ablation variant (E233P/L234V/L235A/G236del/S267K, "IgG1_PVA_/S267k"). The CDRs are underlined. As noted herein and is true for every sequence herein containing CDRs, the exact identification of the CDR locations may be slightly different depending on the numbering used as is shown in Table 1, and thus included herein are not only the CDRs that are underlined but also CDRs included within the VH and VL domains using other numbering systems.

FIG. 75 depicts the sequences for an anti-PD-1 antibody with the variable regions from pembrolizumab. It is important to note that these sequences were generated based on human IgG4, with a S228P variant. The CDRs are underlined. As noted herein and is true for every sequence herein containing CDRs, the exact identification of the CDR locations may be slightly different depending on the numbering used as is shown in Table 1, and thus included herein are not only the CDRs that are underlined but also CDRs included within the VH and VL domains using other numbering systems.

Figure 76A:
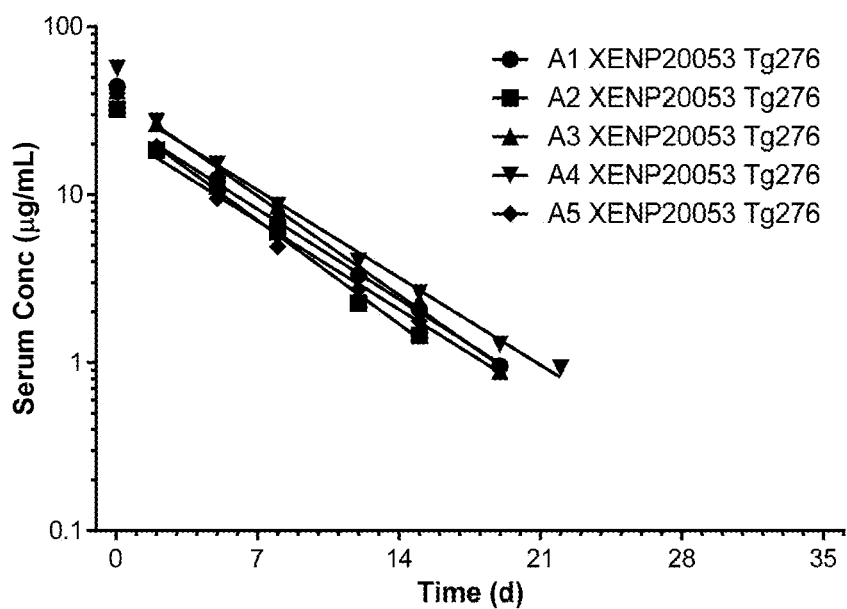
Figure 76B:
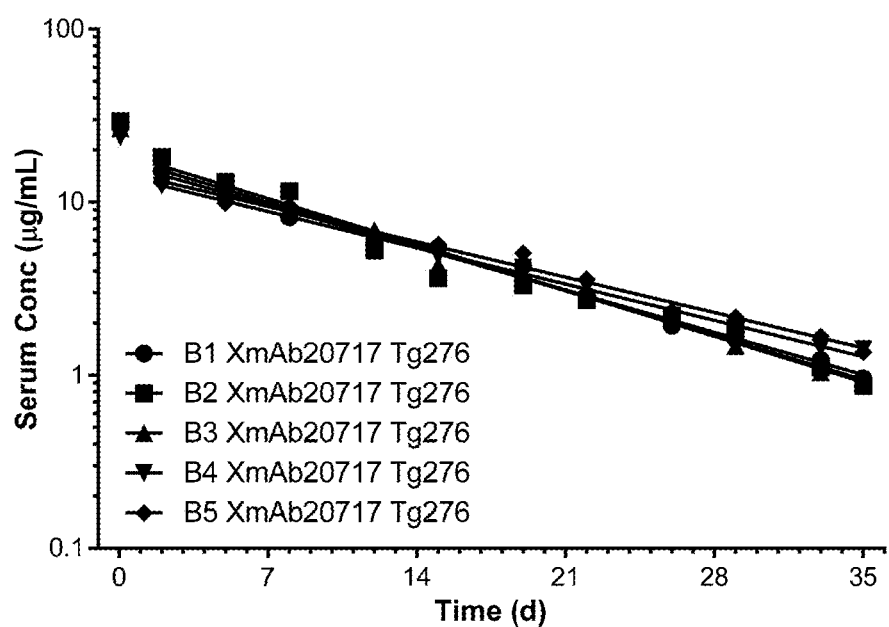

FIGS. 76A and 76B depict the pharmacokinetic profile for A) XENP20053 and B) XmAb20717 in individual mice following 2 mg/kg single i.v. administration in hFcRn (Tg276) mice.

Figure 77:
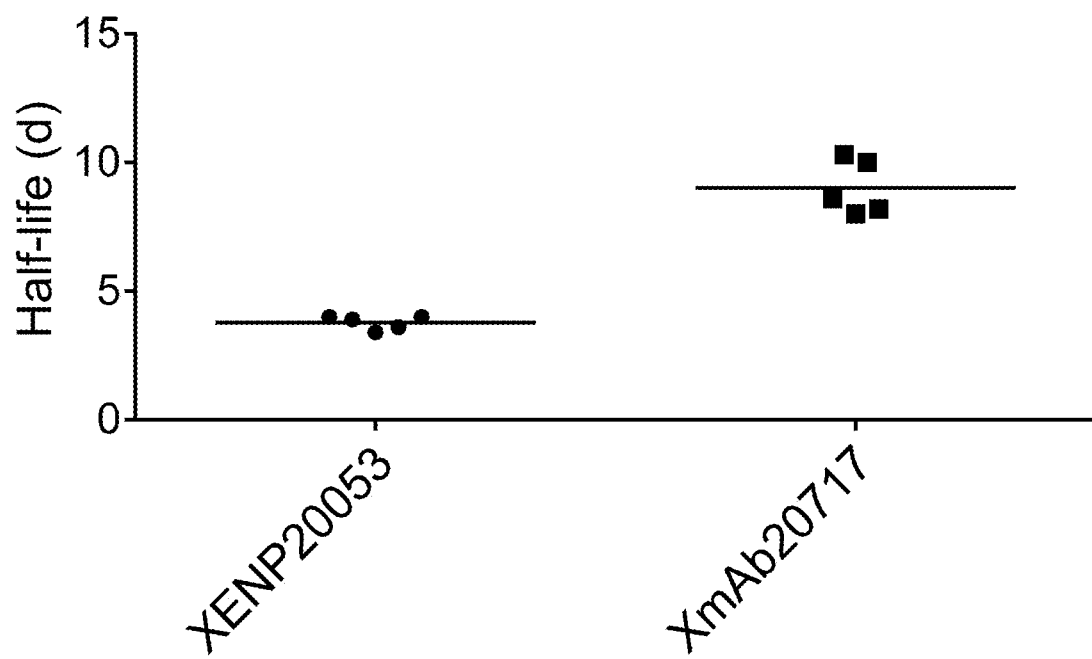

FIG. 77 depicts the half-life of XENP20053 and XmAb20717 (individual animals) following 2 mg/kg single dose i.v. administration in hFcRn (Tg276) mice.

Figure 78:
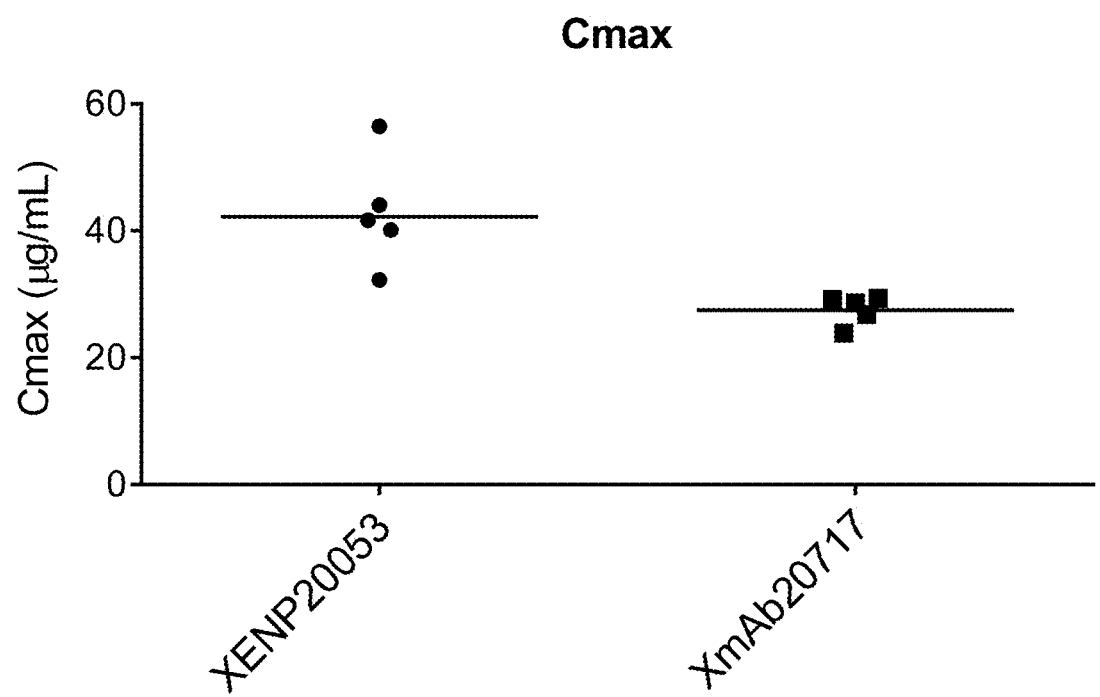
Figure 80A:
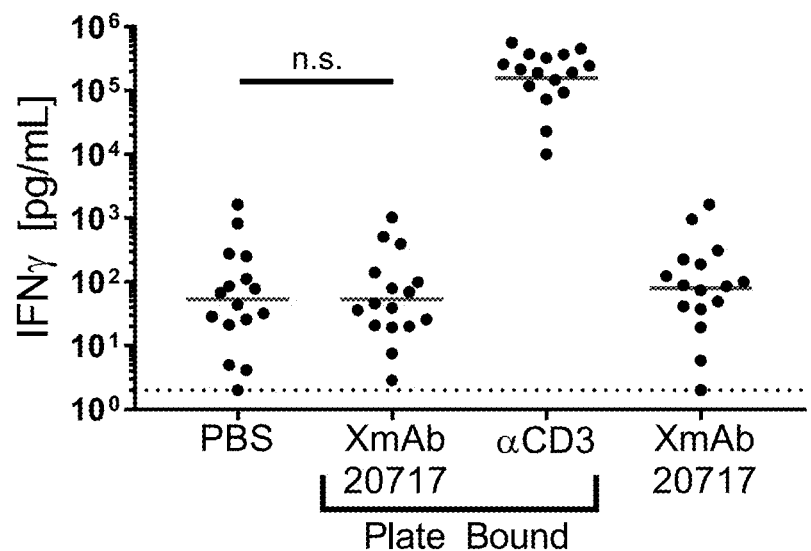
Figure 80B:
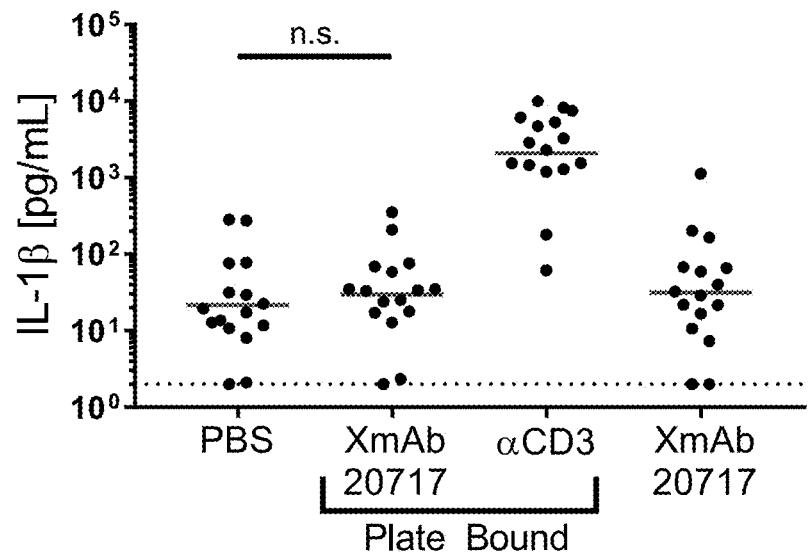
Figure 80C:
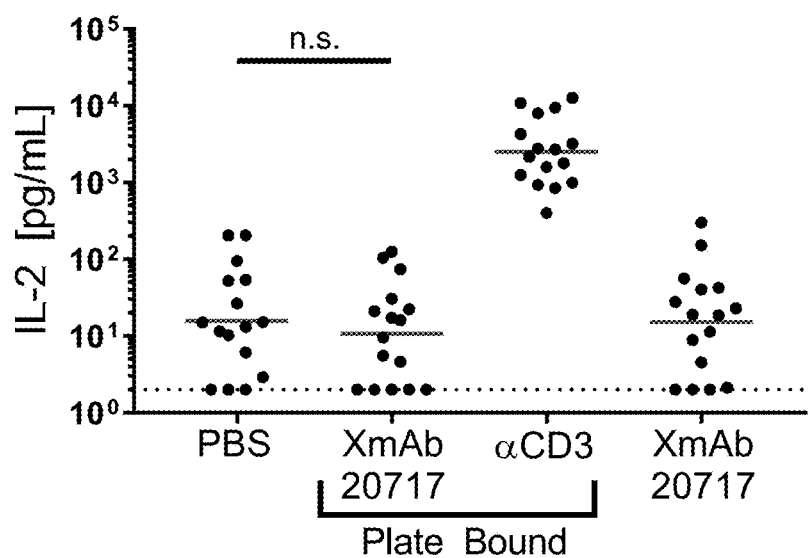
Figure 80D:
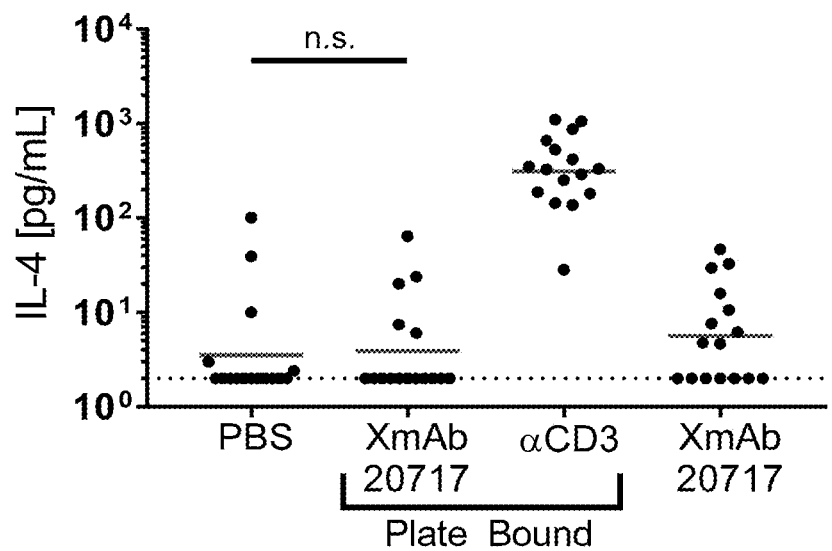
Figure 80E:
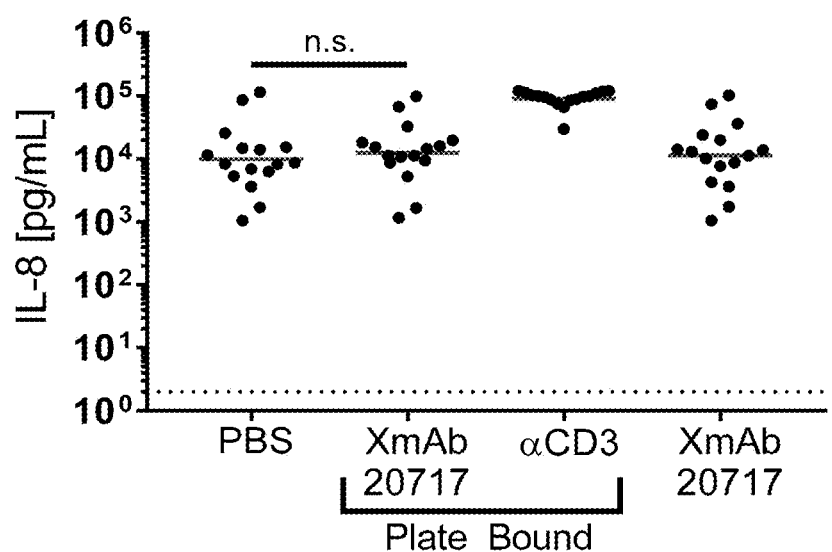
Figure 80F:
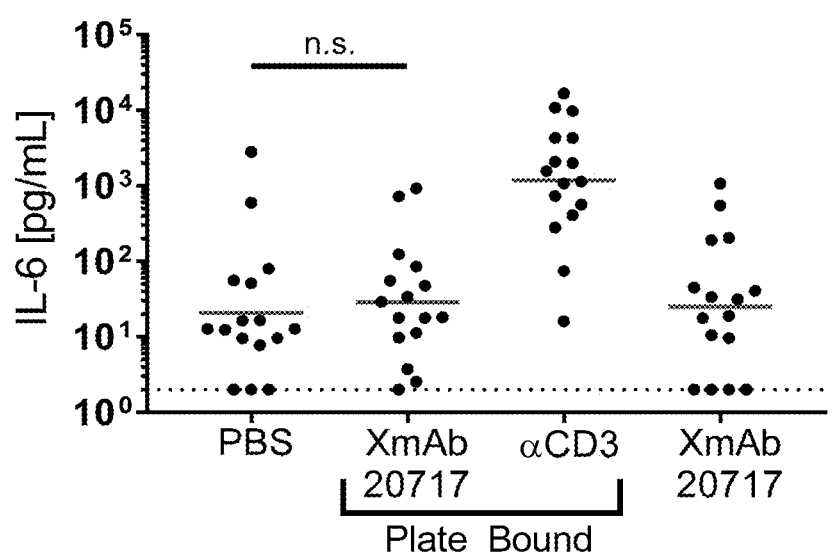
Figure 80G:
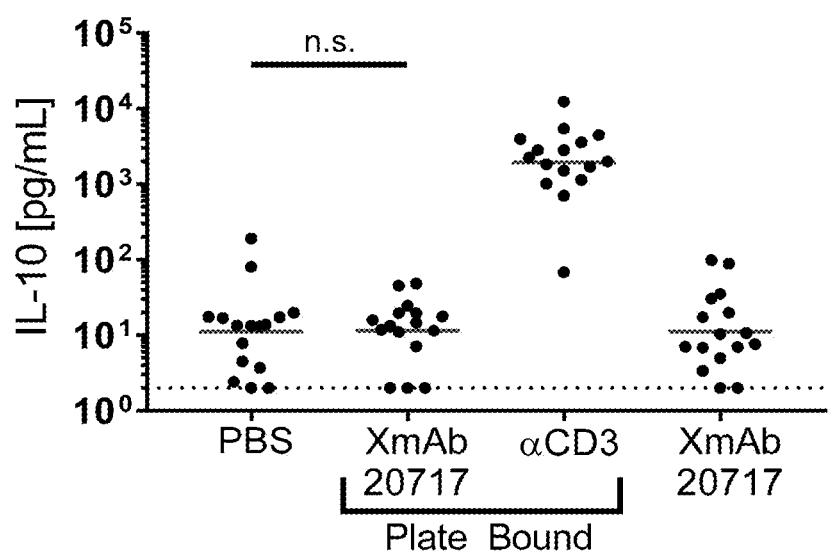
Figure 80H:
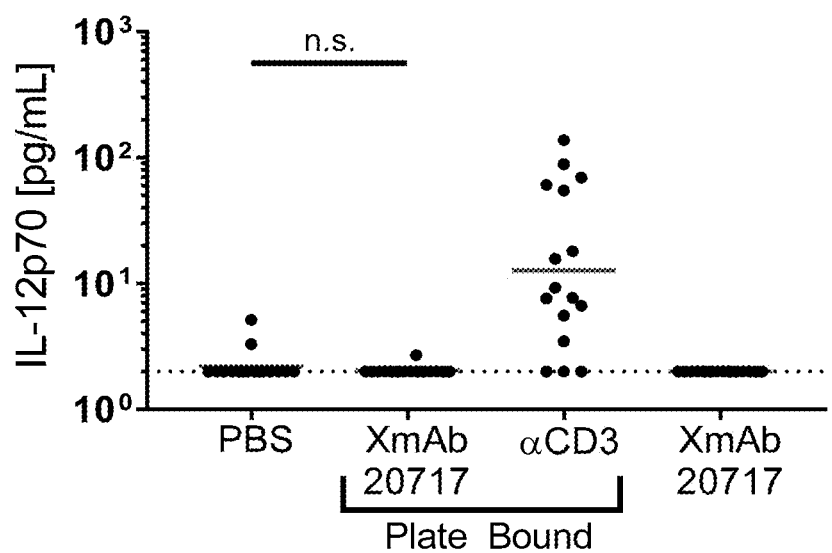
Figure 80I:
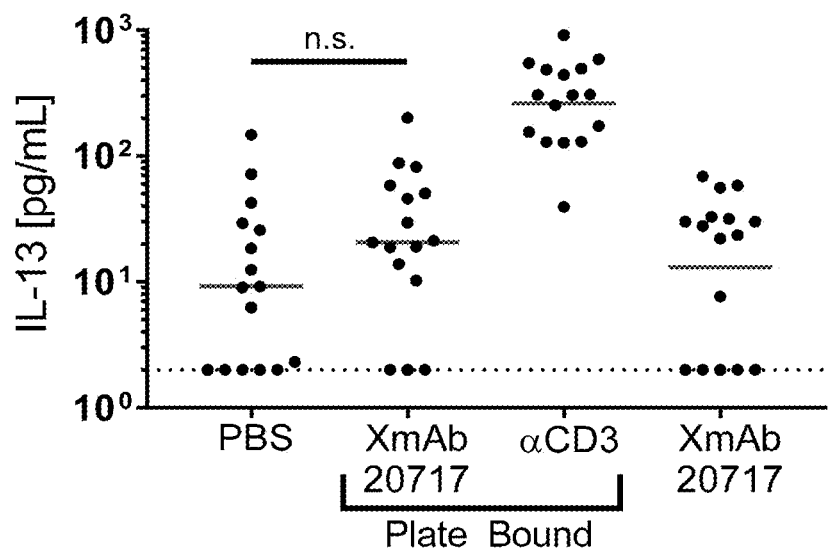
Figure 80J:
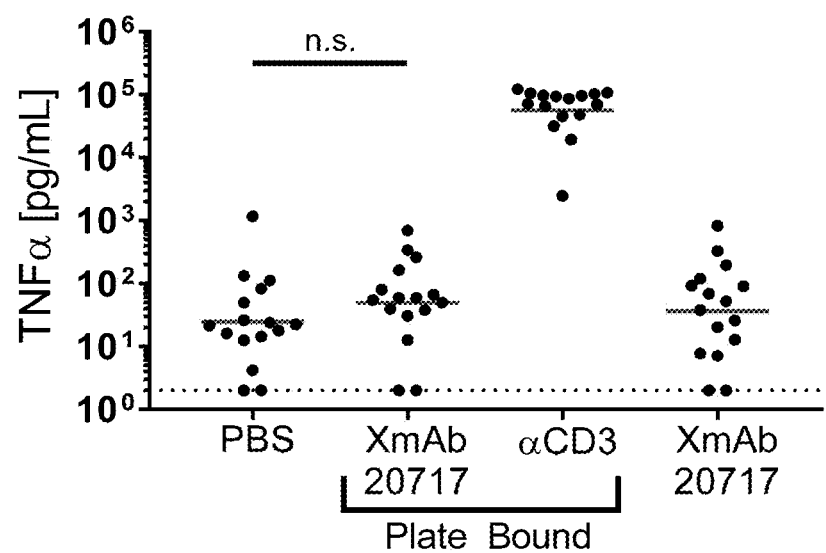

FIG. 78 depicts $C_{max}$ of XENP20053 and XmAb20717 (individual animals) following 2 mg/kg single dose i.v. administration in hFcRn (Tg276) mice.

FIG. 79 depicts the mean of selected PK parameters of XmAb20717 and XENP20053 following 2 mg/kg single dose i.v. administration in hFcRn (Tg276) mice.

FIGS. 80A to 80J depict the release of A) IFNγ, B) IL-1ß, C) IL-2, D) IL-4, E) IL-8, F) IL-6, G) IL-10, H) IL-12p70, I) IL-13, and J) TNFα from human PBMCs treated with PBS, plate-bound XmAb20717, soluble XmAb20717, and plate-bound anti-CD3 antibody (OKT3).

Figure 81A:
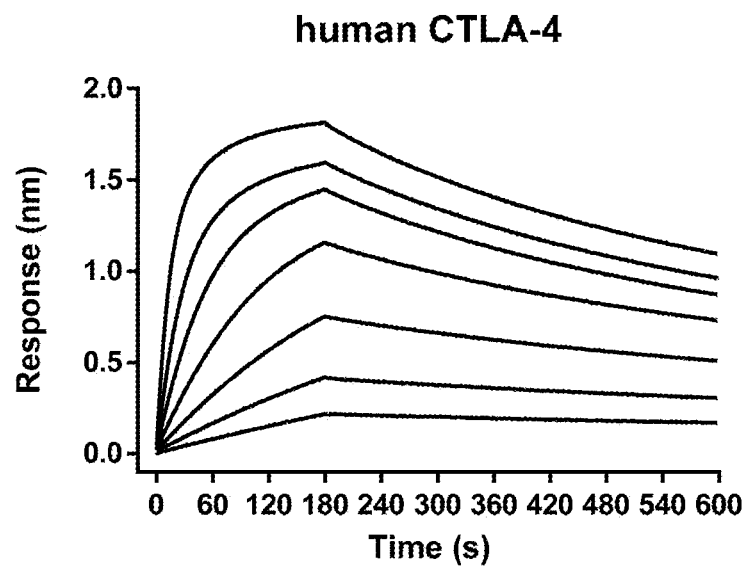
Figure 81B:
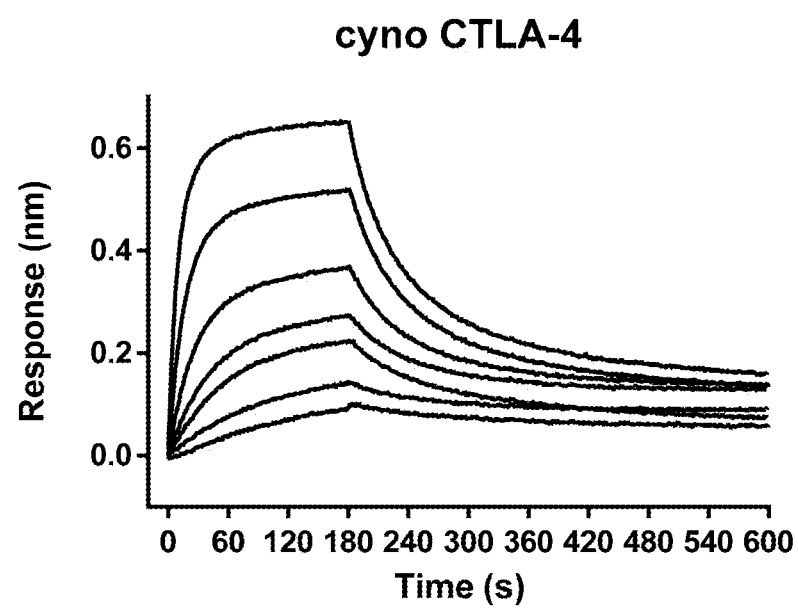

FIGS. 81A and 81B depict sensorgrams showing binding of XmAb20717 to A) human CTLA-4 and B) cynomolgus CTLA-4.

Figure 82A:
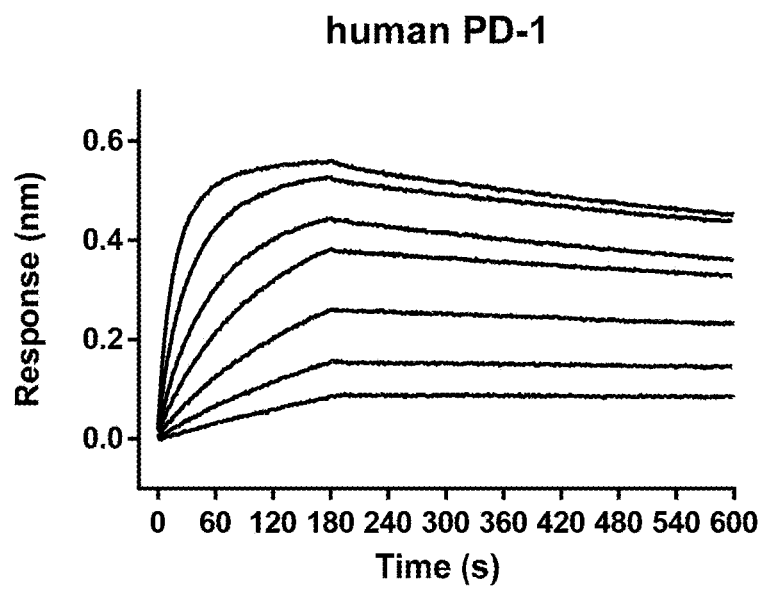
Figure 82B:
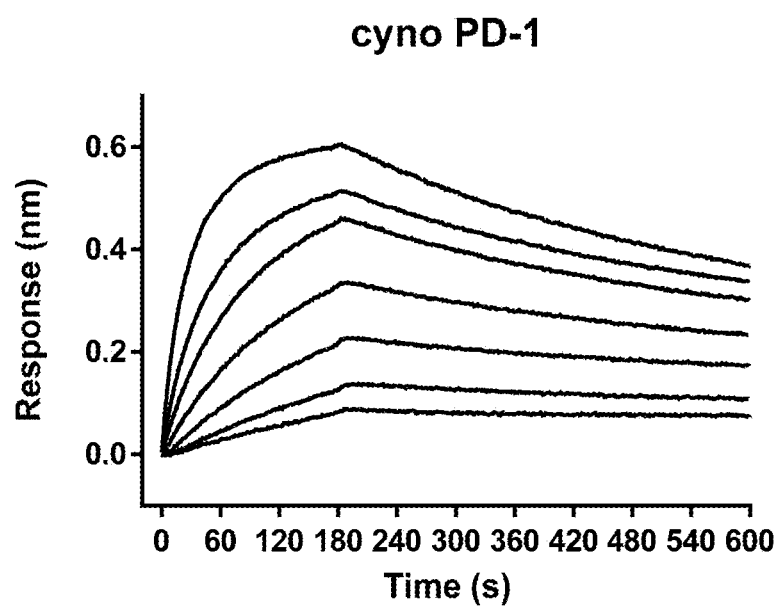

FIGS. 82A and 82B depict sensorgrams showing binding of XmAb20717 to A) human PD-1 and B) cynomolgus PD-1.

FIG. 83 depicts the equilibrium dissociation constants $(K_D)$, association rates $(k_a)$, and dissociation rates $(k_d)$ for binding of XmAb20717 to human and cynomolgus CTLA-4 and PD-1.

Figure 84:
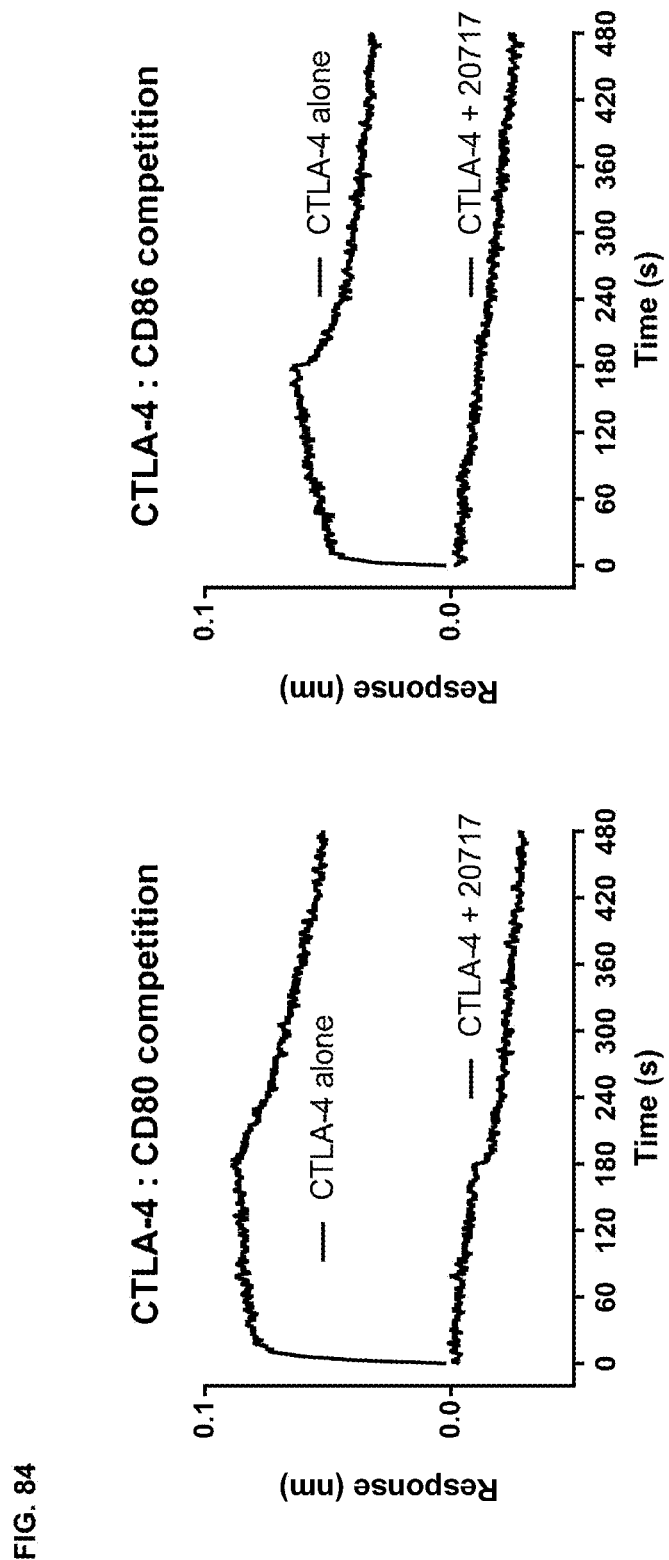

FIG. 84 depicts sensorgrams from competition binding experiments of CTLA-4 and ligands CD80 and CD86 with and without XmAb20717 pre-incubation.

Figure 85:
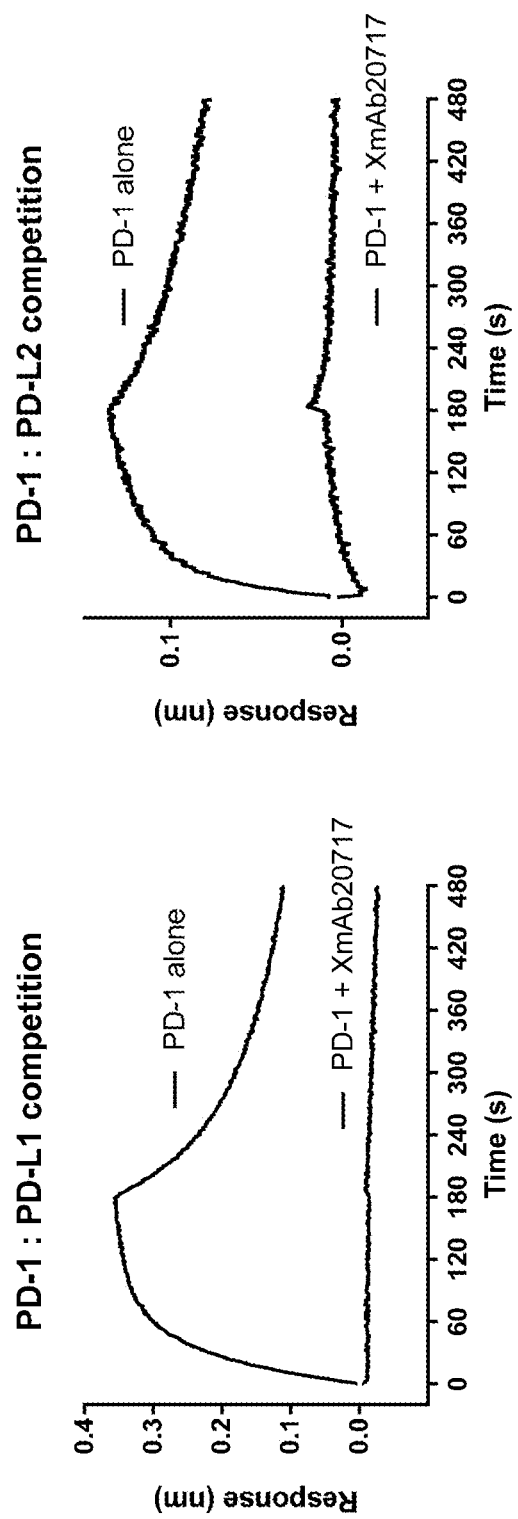

FIG. 85 depicts sensorgrams from competition binding experiments of PD-1 and ligands PD-L1 and PD-L2 with and without XmAb20717 pre-incubation.

Figure 86:
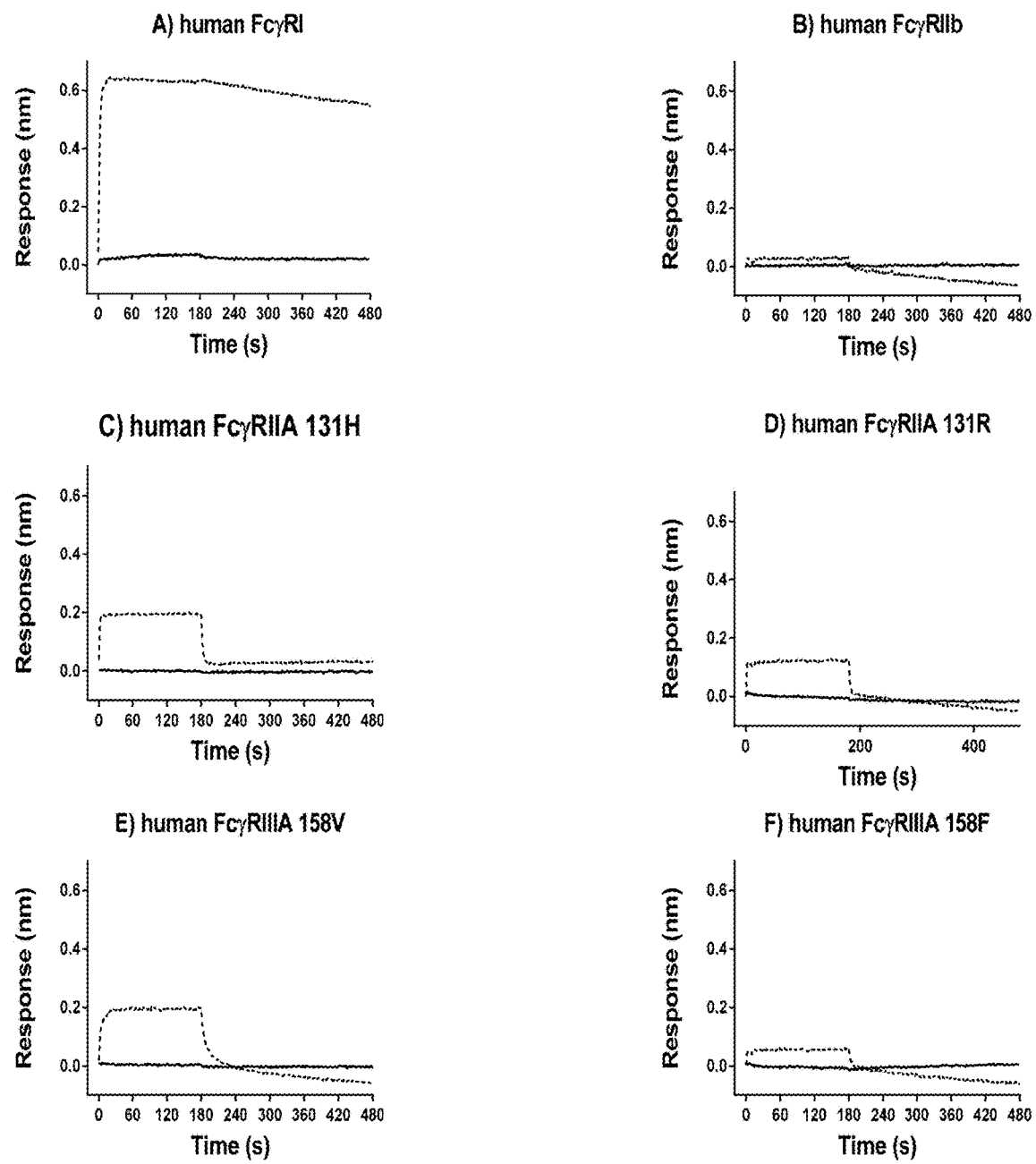

FIG. 86 depicts sensorgrams showing binding of XmAb20717 (solid line) and human IgG comparator (an anti-CD19 antibody with a native IgG1 constant region; dotted line) to A) human FcγRI, B) human FcγRIIb, C) human FcγRIIA (131H), D) human FcγRIIA (131R), E) human FcγRIIIA (158V), and F) human FcγRIIIA (158F).

Figure 87:
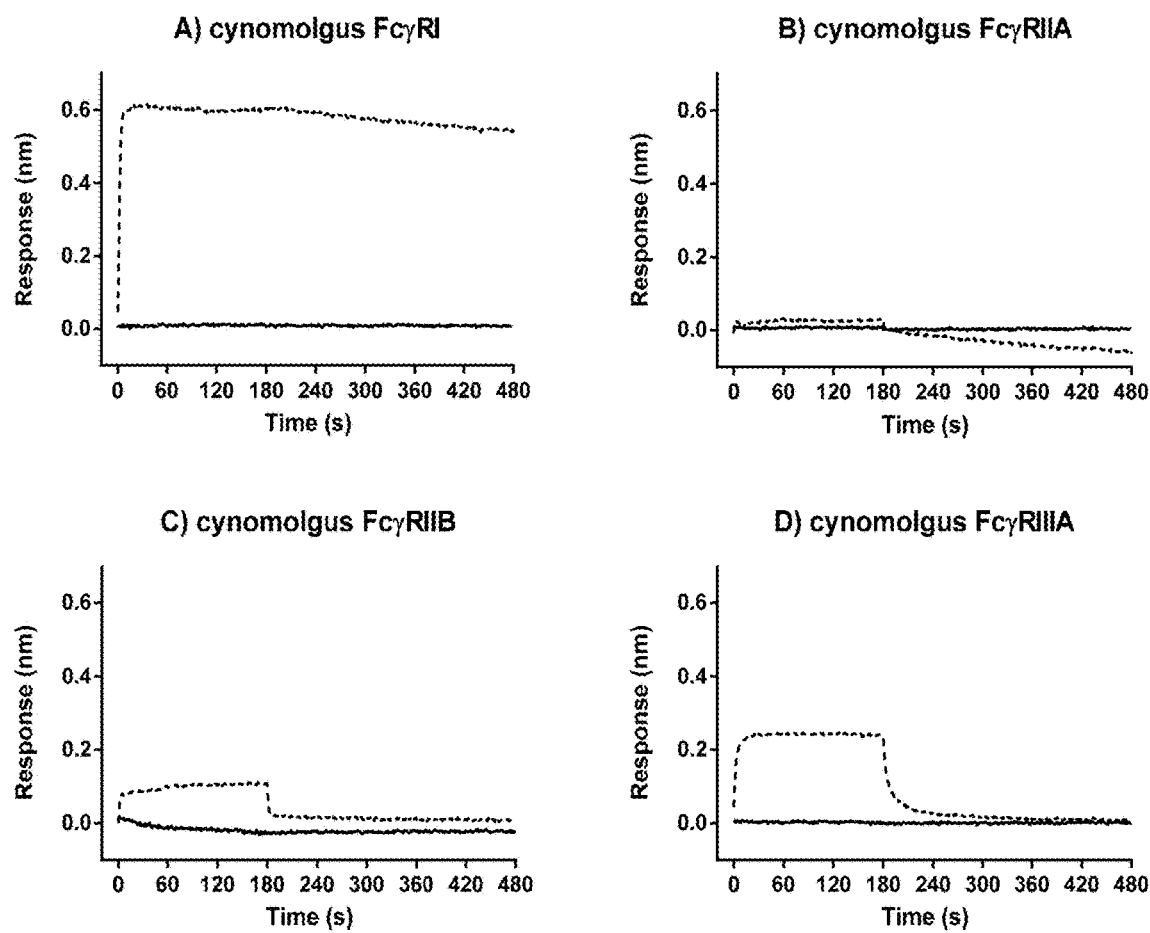

FIG. 87 depicts sensorgrams showing binding of XmAb20717 (solid line) and human IgG comparator (an anti-CD19 antibody with a native IgG1 constant region; dotted line) to A) cynomolgus FcγRI, B) cynomolgus FcγRIIA, C) cynomolgus FcγRIIb, and D) cynomolgus RcγRIIIA.

Figure 88:
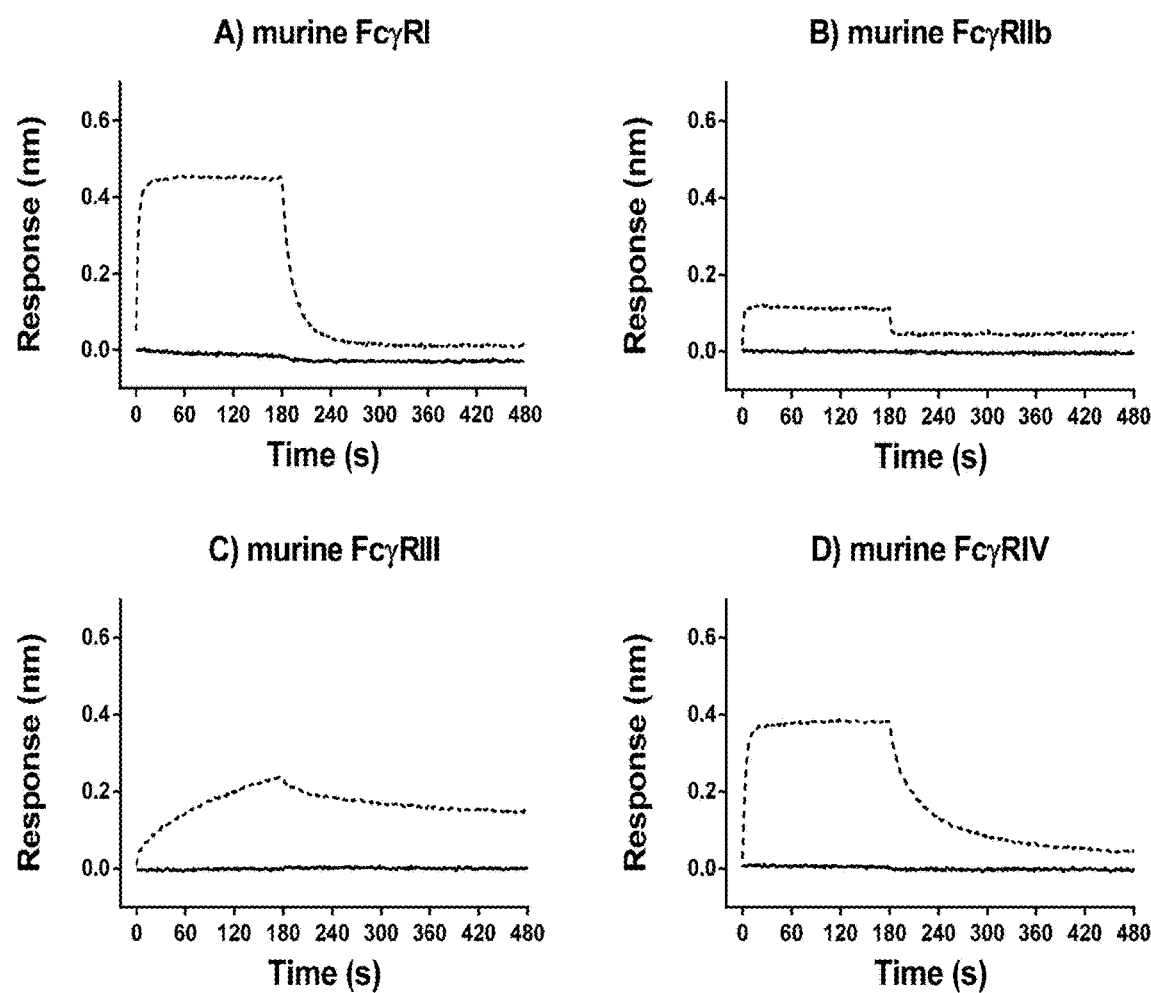

FIG. 88 depicts sensorgrams showing binding of XmAb20717 (solid line) and human IgG comparator (an anti-CD19 antibody with a native IgG1 constant region; dotted line) to A) murine FcγRI, B) murine FcγRIIb, C) murine FcγRIII, and D) murine FcγRIV.

FIG. 89 depicts equilibrium dissociation constants $(K_D)$ for binding of XmAb20717 and XENP20053 to human, cynomolgus, and mouse FcRn at pH 6.0.

Figure 90:
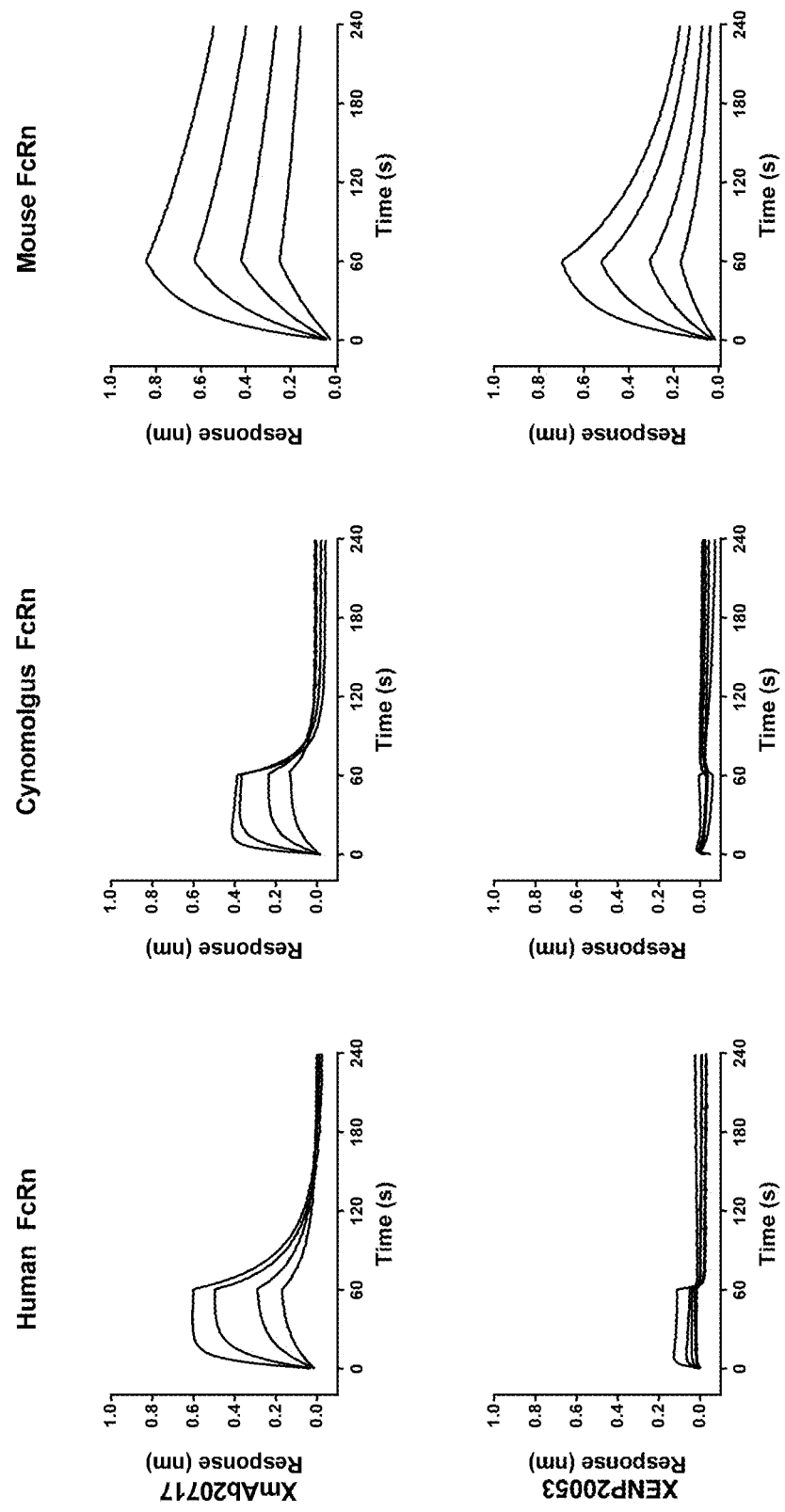

FIG. 90 depicts sensorgrams showing binding of XmAb20717 and XENP20053 to human, cynomolgus, and mouse FcRn (1000, 500, 250, and 125 nM) at pH 6.0.

Figure 91:
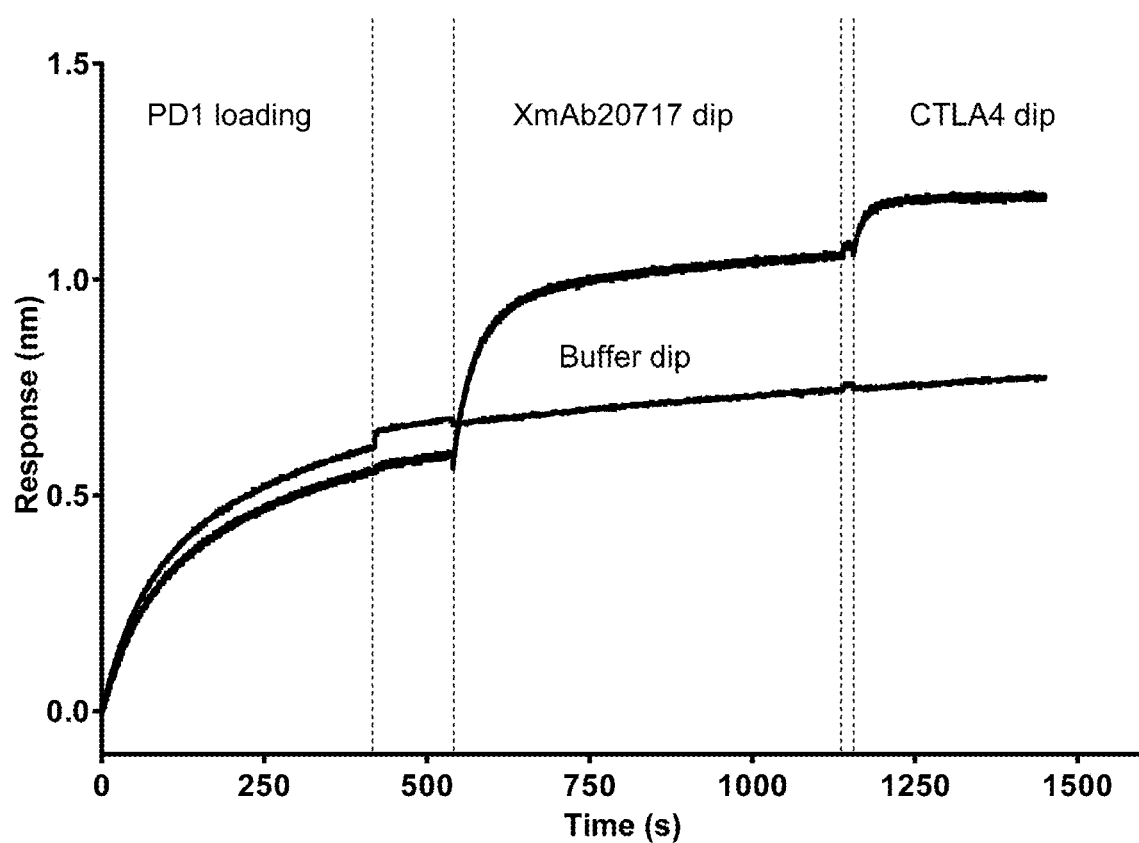

FIG. 91 depicts in-tandem BLI experiment showing biosensors loaded with PD-1 and dipped into XmAb20717 or buffer followed by a final dip into CTLA-4 antigen.

Figure 92:
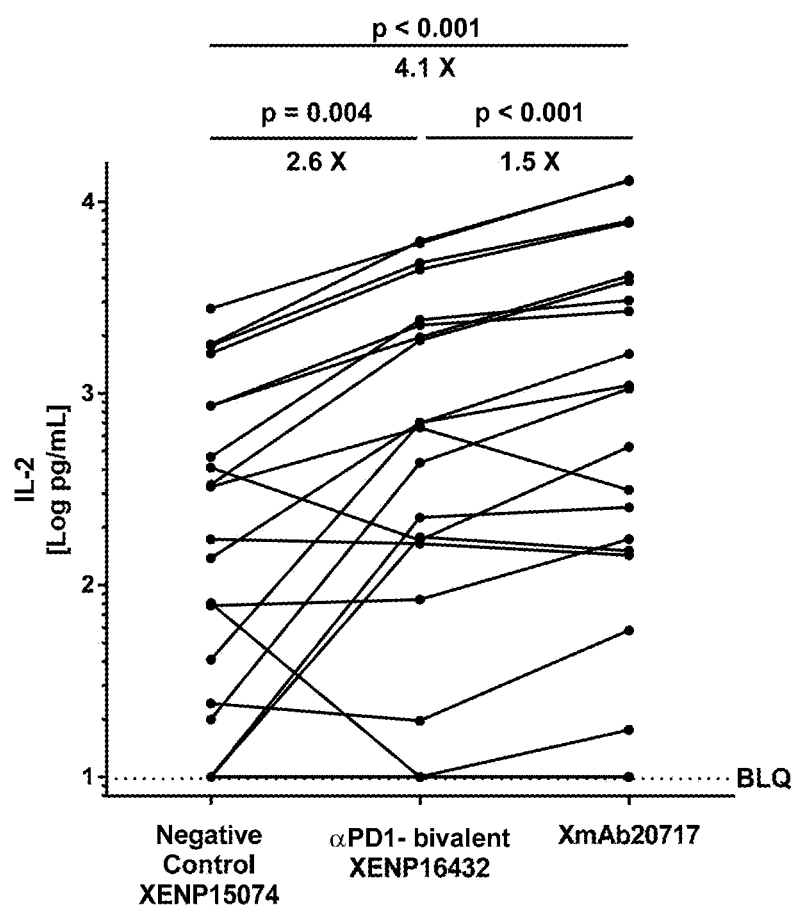

FIG. 92 depicts IL-2 secretion by SEB-stimulated human PBMCs following treatment with anti-RSV mAb XENP15074, anti-PD-1 mAb XENP16432, and XmAb20717. Each point represented a unique human donor.

Figure 93:
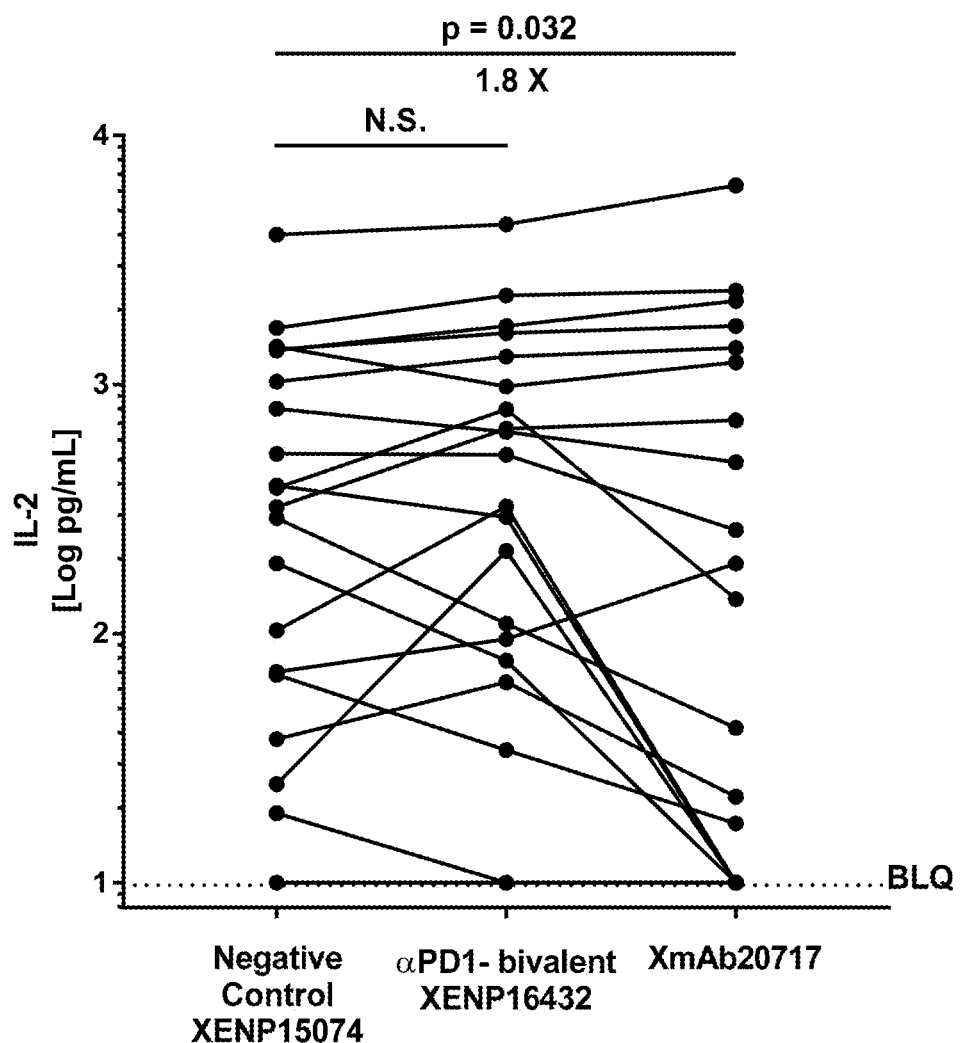

FIG. 93 depicts IL-2 secretion by unstimulated human PBMCs following treatment with anti-RSV mAb XENP15074, anti-PD-1 mAb XENP16432, and XmAb20717. Each point represented a unique human donor.

Figure 94:
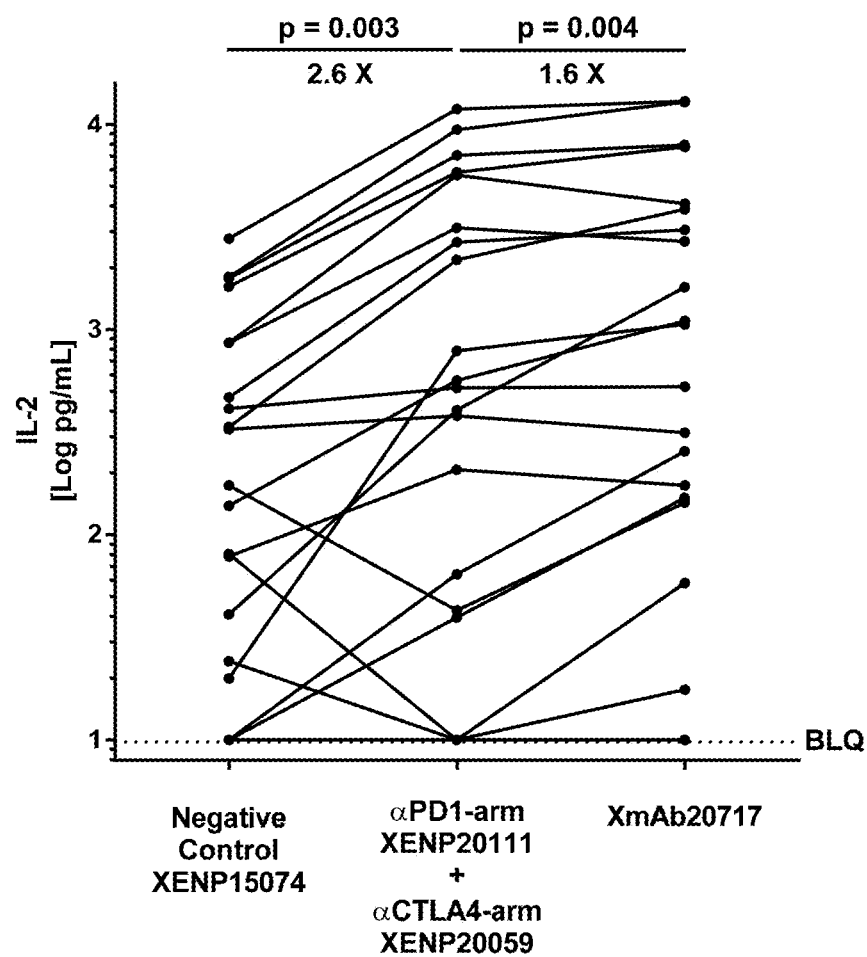

FIG. 94 depicts IL-2 secretion by unstimulated human PBMCs following treatment with anti-RSV mAb XENP15074, a combination of XENP20111 and XENP20059 (monovalent mAbs based on the anti-PD-1 and anti-CTLA-4 binding domains of XmAb20717), and XmAb20717. Each point represented a unique human donor.

Figure 95:
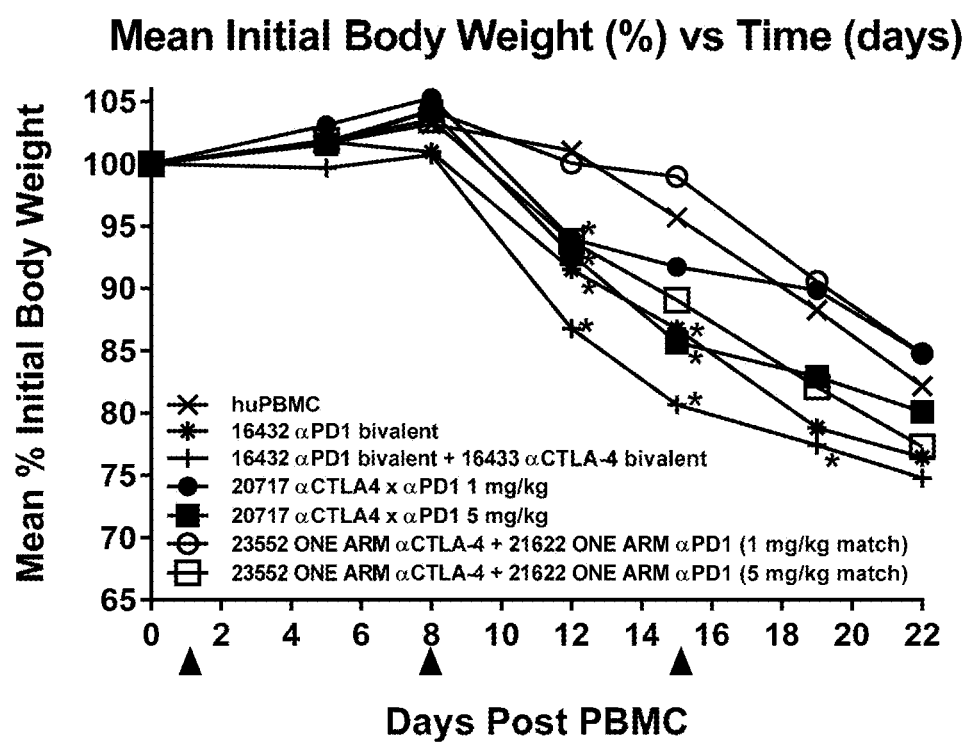

FIG. 95 depicts changes in body weight over time (as a percentage of initial body weight) in NSG mice engrafted i.v. OSP with human PBMCs and dosed with the indicated test articles. Dead mice were set to 70% initial body weight. * denotes $p<0.05$, unpaired Student's t-test, each group compared to huPBMCs. Triangles indicate dosing days.

Figure 96:
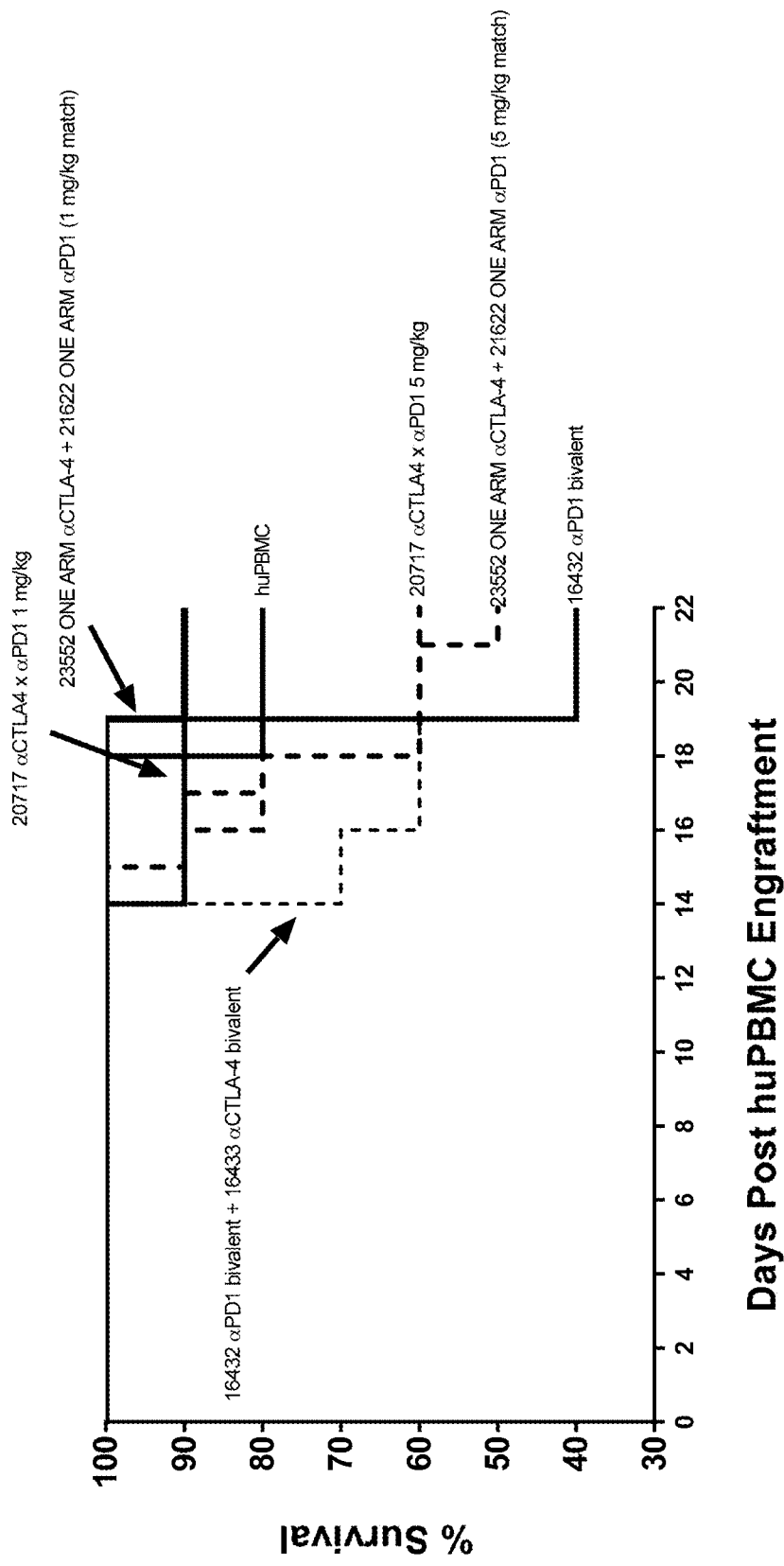

FIG. 96 depicts the survival of NSG mice engrafted i.v. OSP with human PBMCs and dosed with the indicated test articles.

Figure 97:
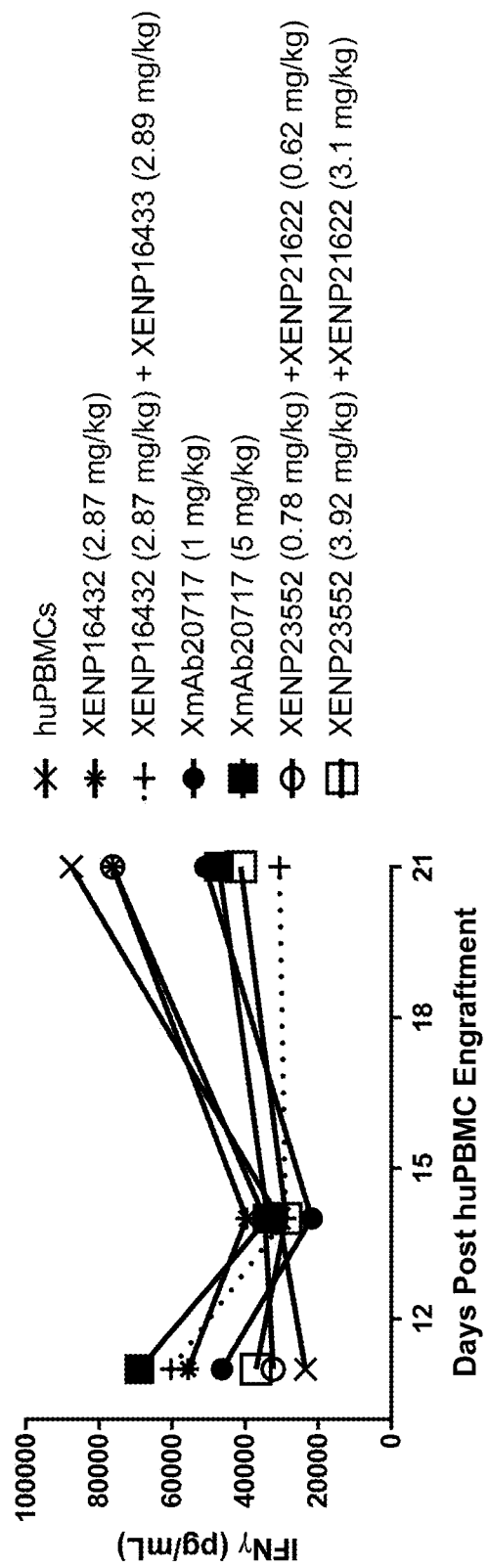

FIG. 97 depicts serum IFNγ concentration over time in NSG mice engrafted i.v. OSP with human PBMCs and dosed with the indicated test articles.

Figure 98A:
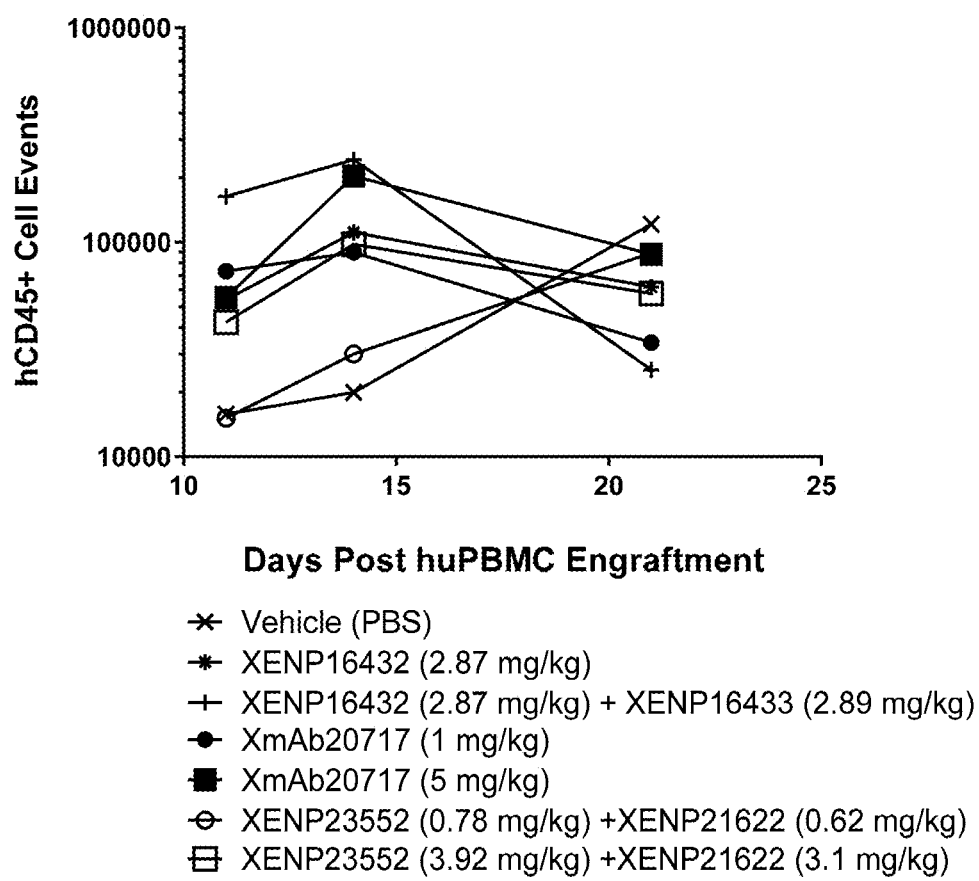
Figure 98B:
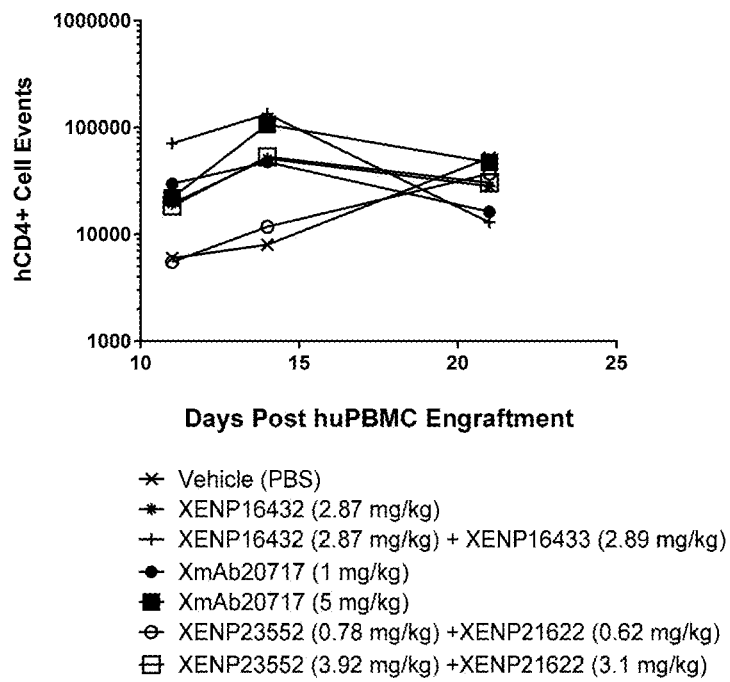
Figure 98C:
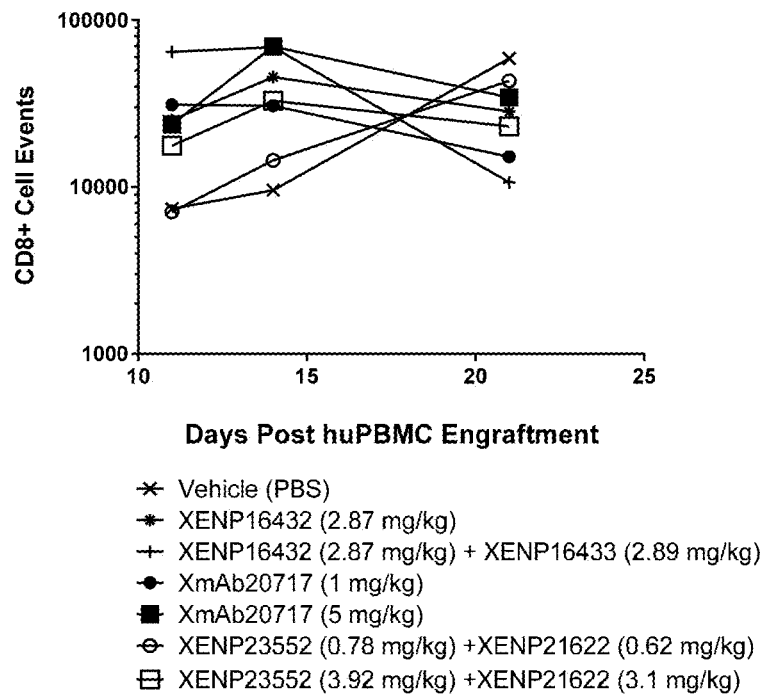

FIGS. 98A to 98C depicts A) human CD45$^+$ cell, B) human CD4$^+$ T cell, and C) human CD8$^+$ T cell counts over time in blood of NSG mice engrafted i.v. OSP with human PBMCs and dosed with the indicated test articles.

FIG. 99 depicts the sequences for XENP16434, a bivalent anti-PD-L1 mAb based on atezolizumab with an ablation variant (E233P/L234V/L235A/G236del/S267K, "IgG1_PVA_/S267k").

Figure 100:
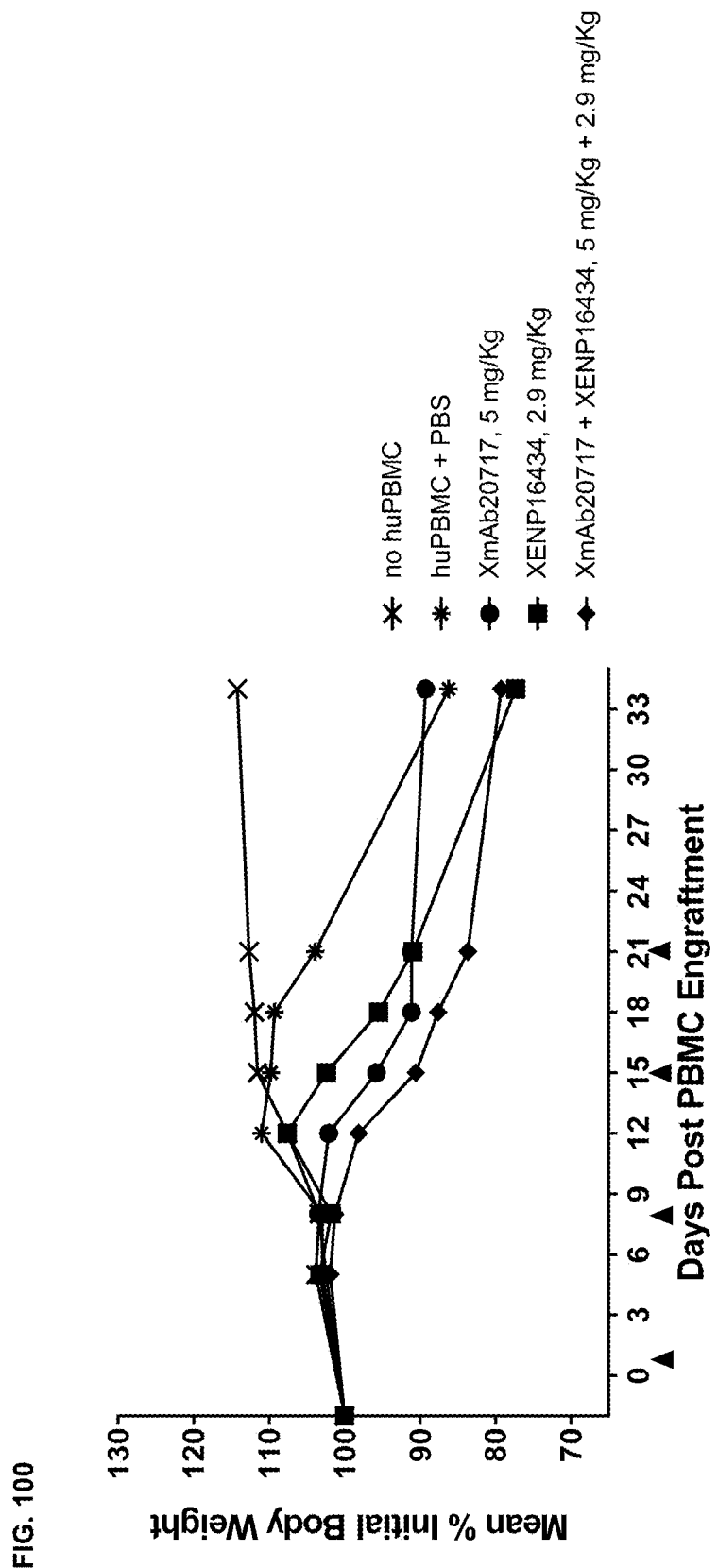

FIG. 100 depicts changes in body weight over time (as a percentage of initial body weight) in NSG mice engrafted i.v. OSP with human PBMCs and dosed with the indicated test articles. Dead mice were set to 70% initial body weight.

Figure 101:
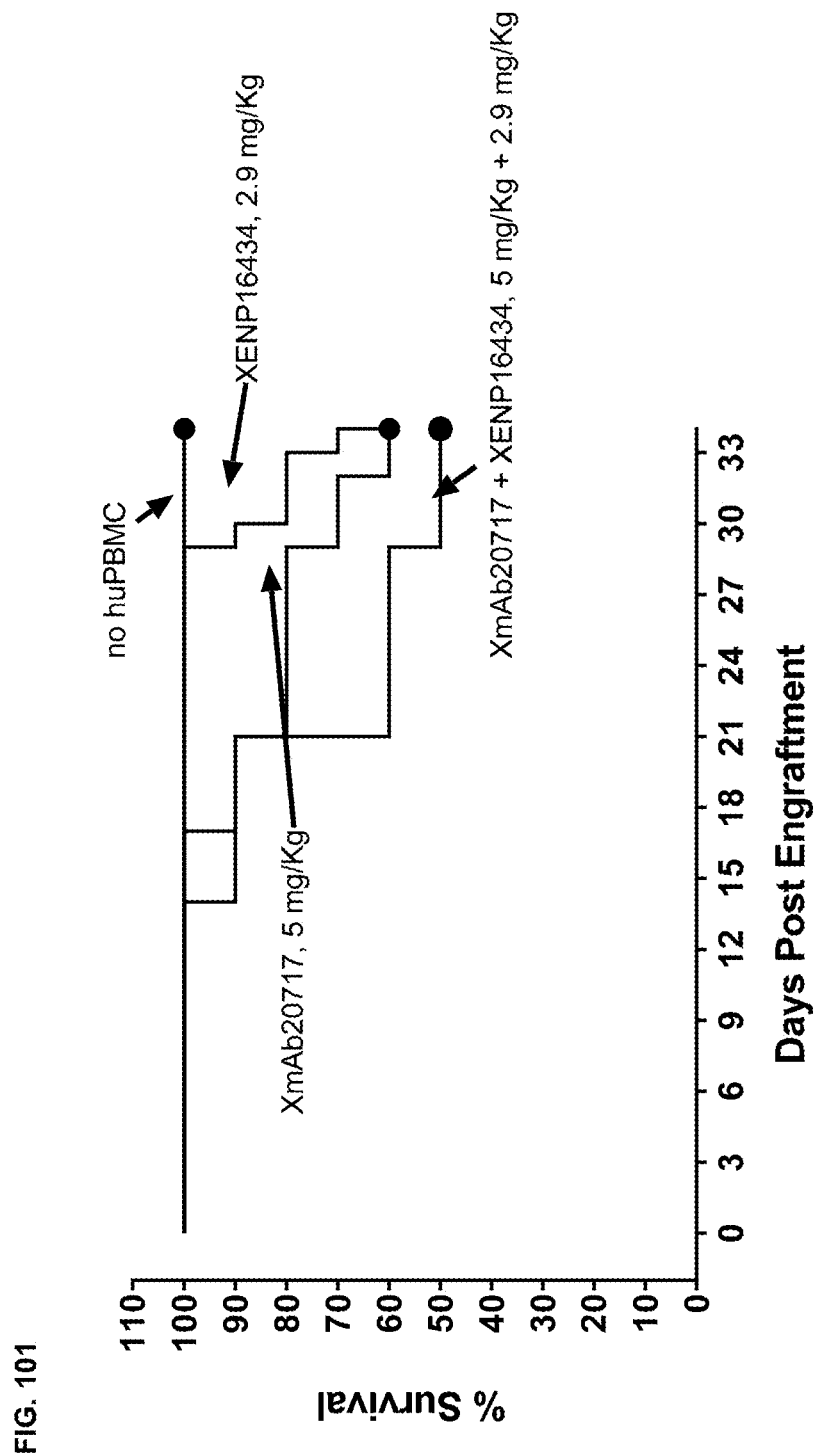

FIG. 101 depicts the survival of NSG mice engrafted i.v. OSP with human PBMCs and dosed with the indicated test articles.

Figure 102A:
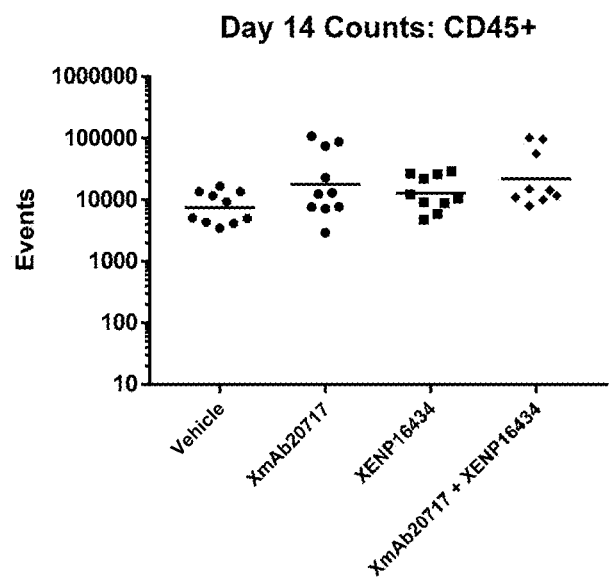
Figure 102B:
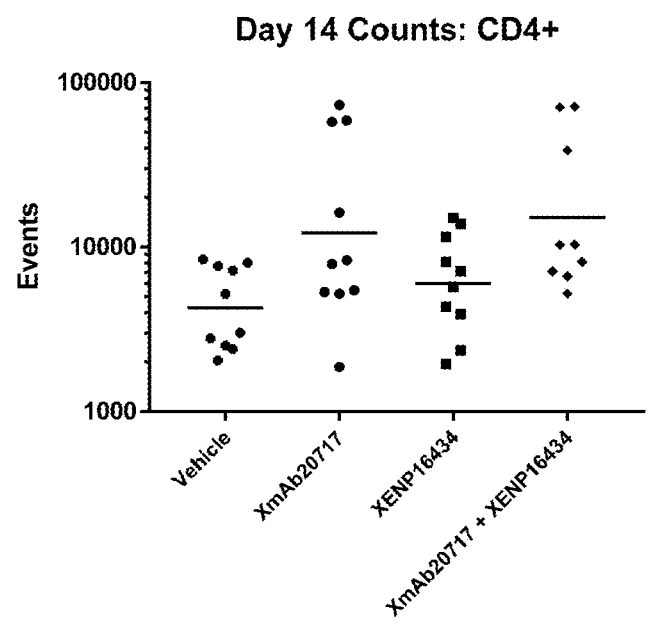
Figure 102C:
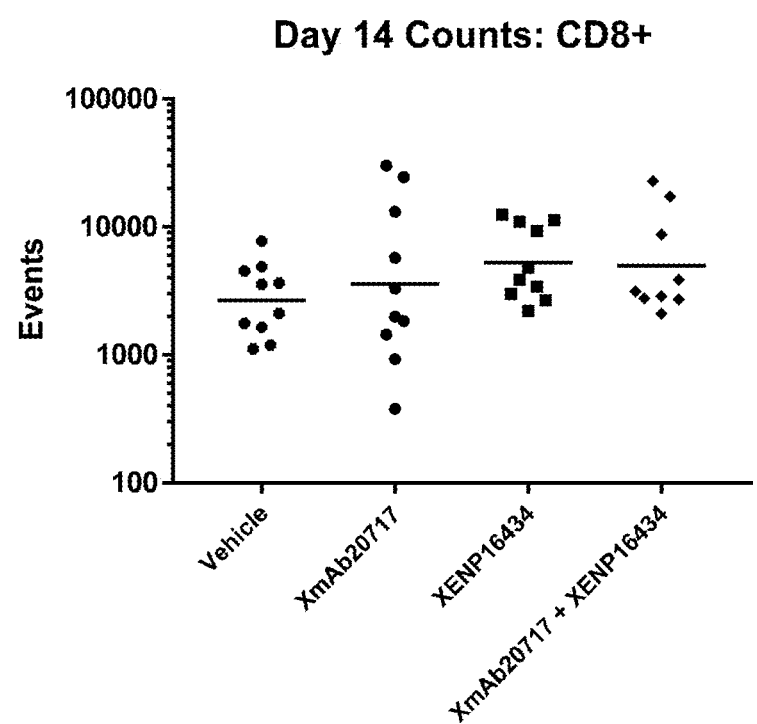

FIGS. 102A to 102C depicts A) human CD45⁺ cell, B) human CD4⁺ T cell, and C) human CD8⁺ T cell counts on Day 14 in blood of NSG mice engrafted i.v. OSP with human PBMCs and dosed with the indicated test articles.

Figure 103:
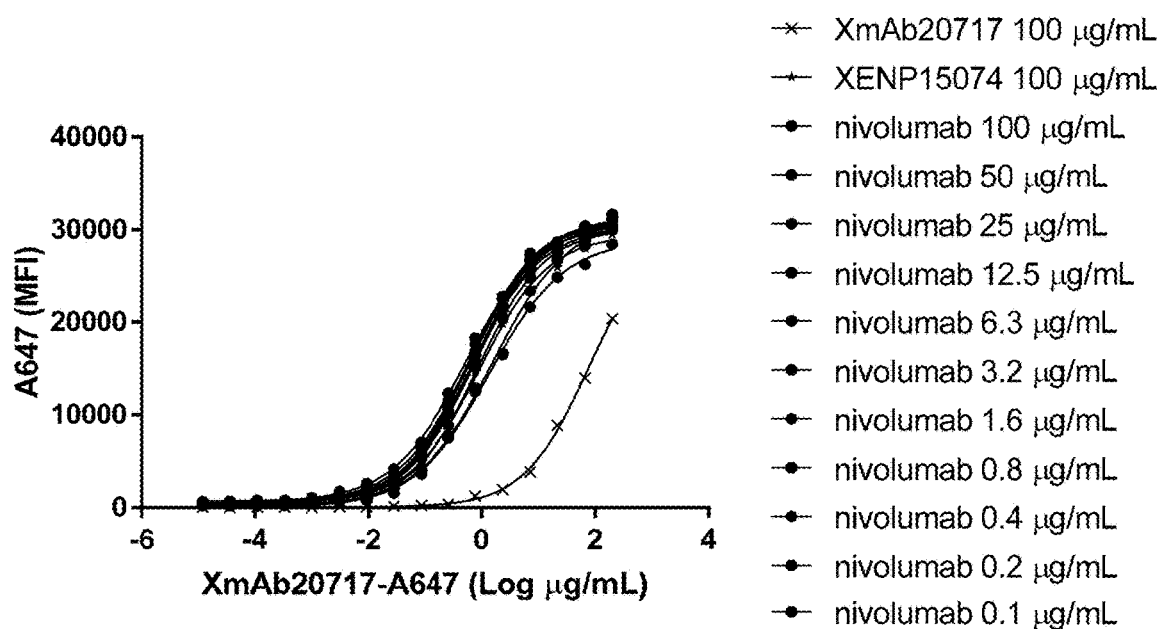

FIG. 103 depicts the binding of XmAb20717 to PD-1⁺ CTLA-4⁺ cells pretreated with the indicated concentrations of the indicated test articles.

Figure 104:
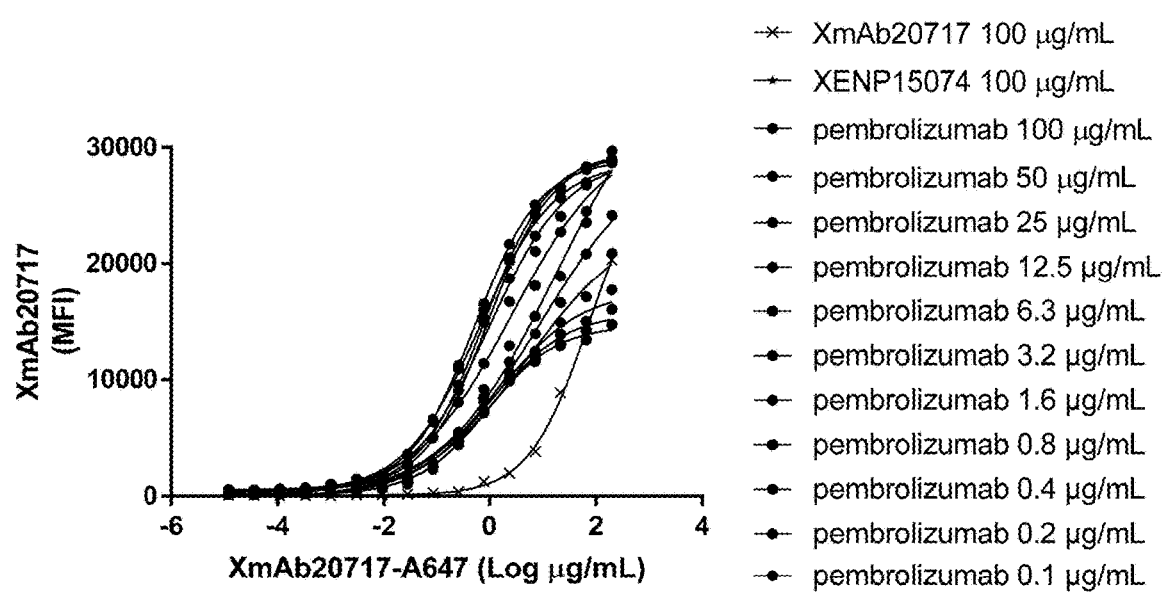

FIG. 104 depicts the binding of XmAb20717 to PD-1⁺ CTLA-4₊ cells pretreated with the indicated concentrations of the indicated test articles.

Figure 105:
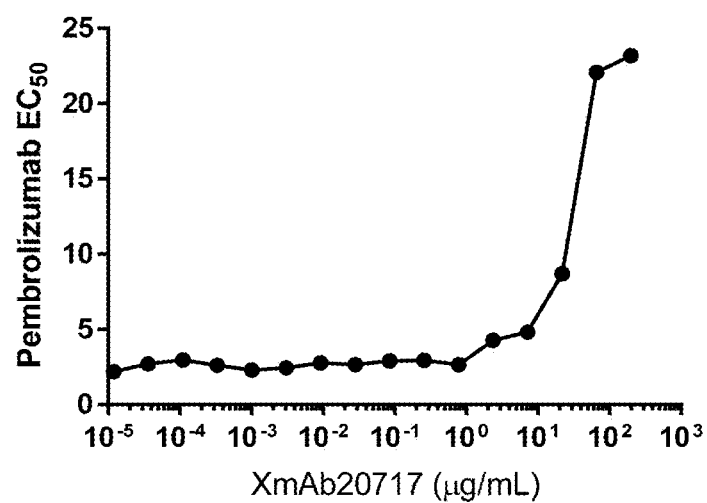
Figure 106A:
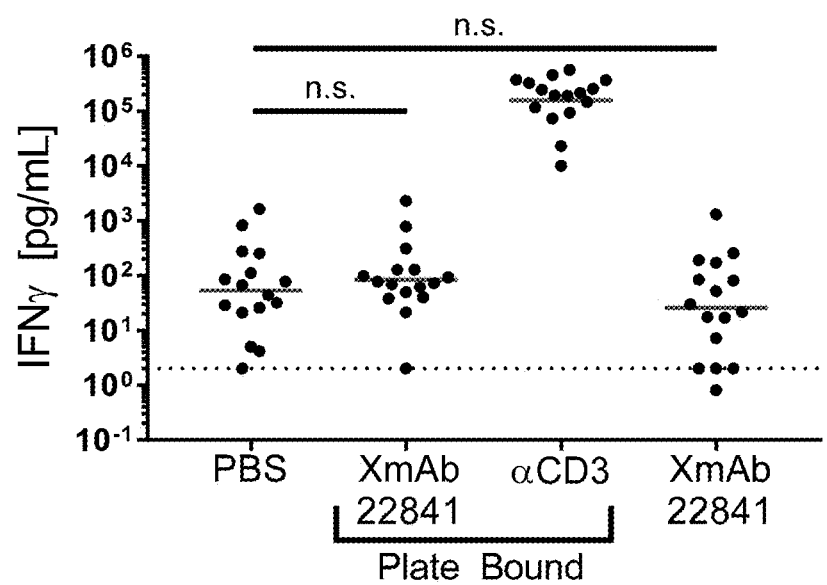
Figure 106B:
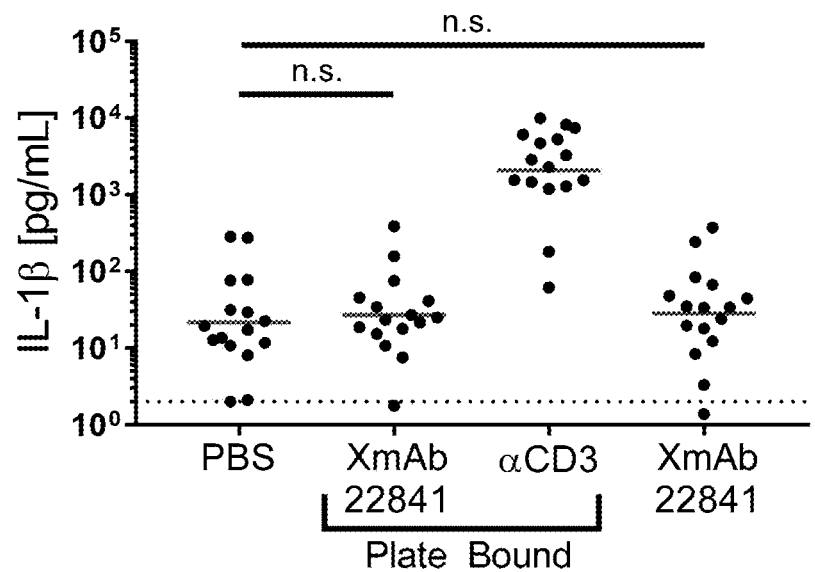
Figure 106C:
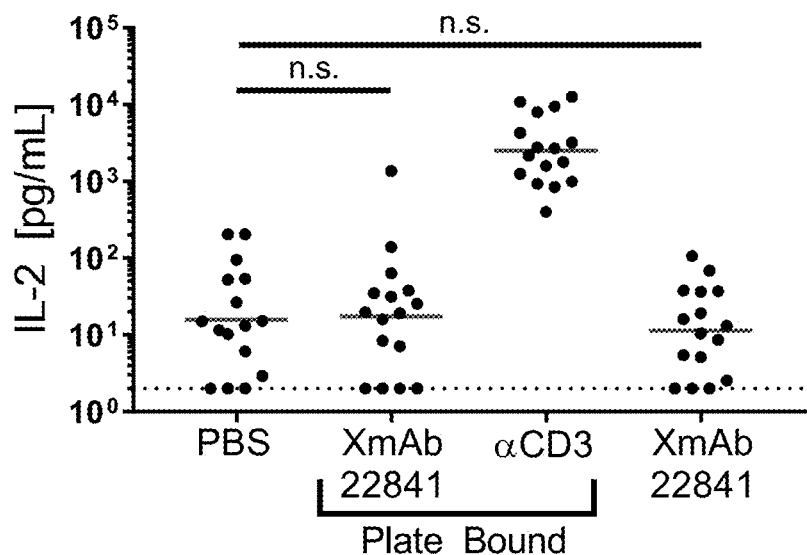
Figure 106D:
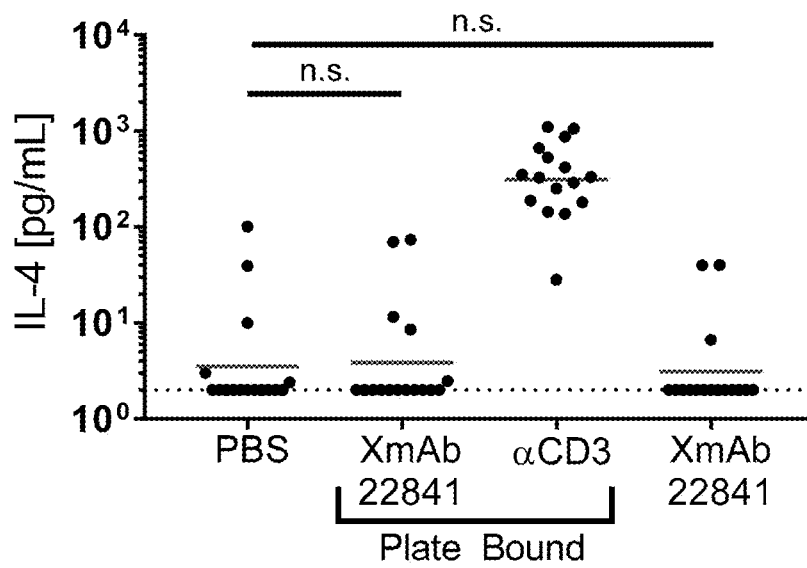
Figure 106E:
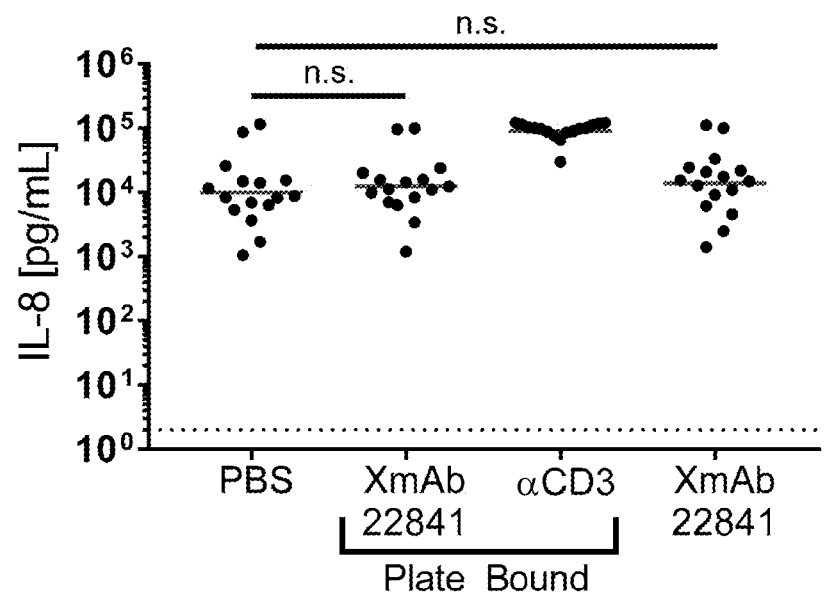
Figure 106F:
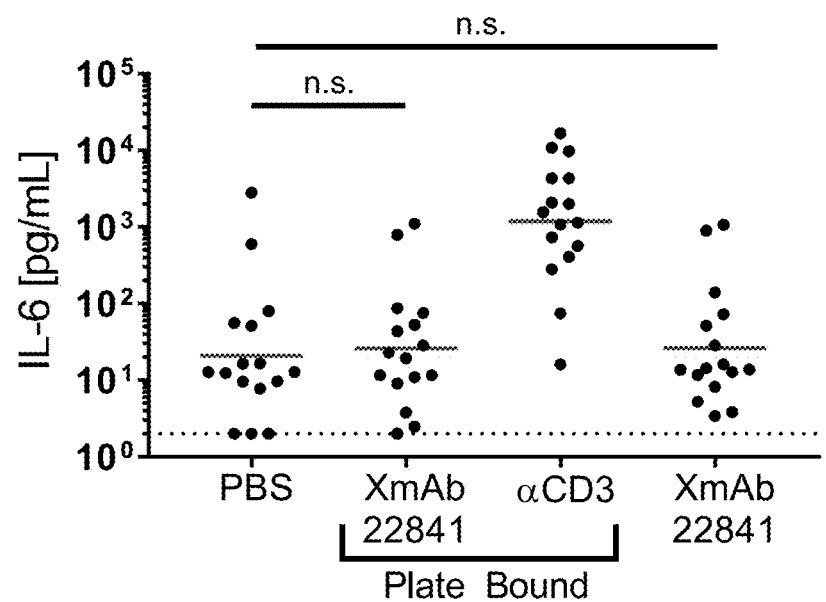
Figure 106G:
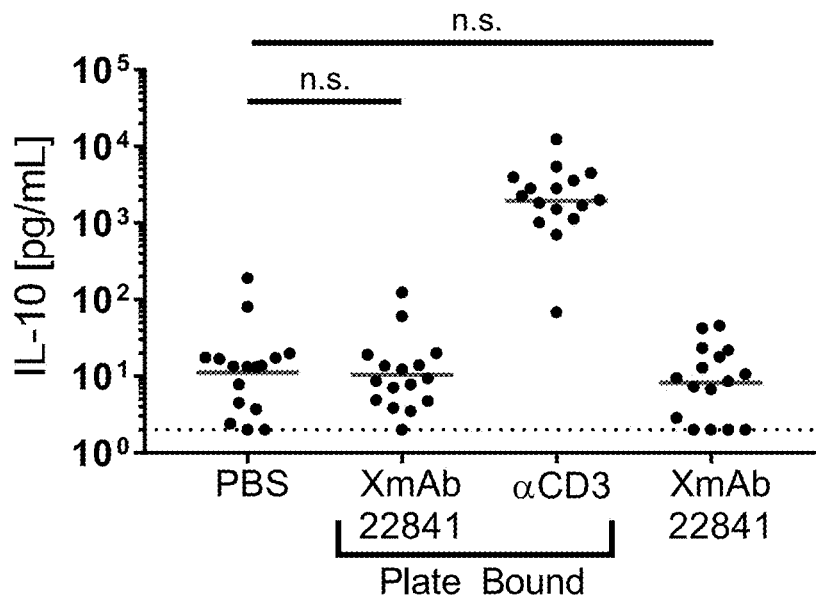
Figure 106H:
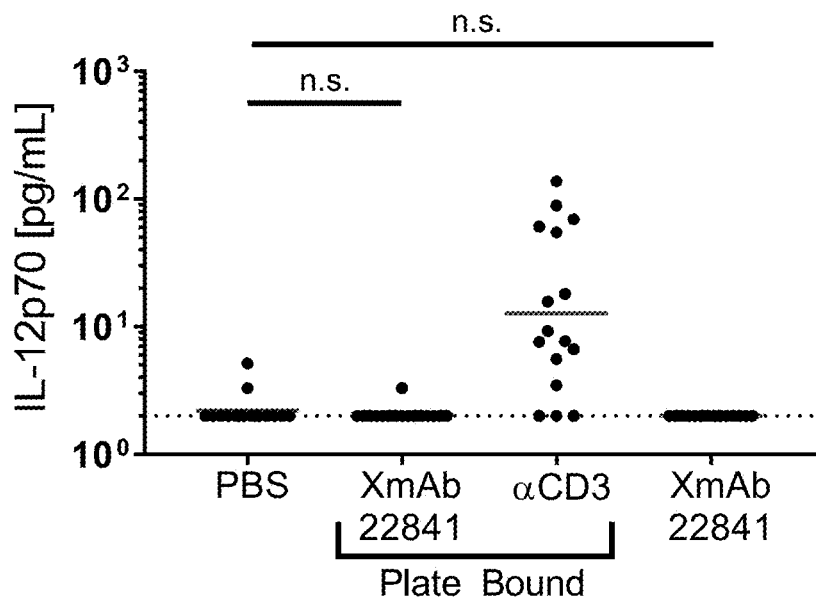
Figure 106I:
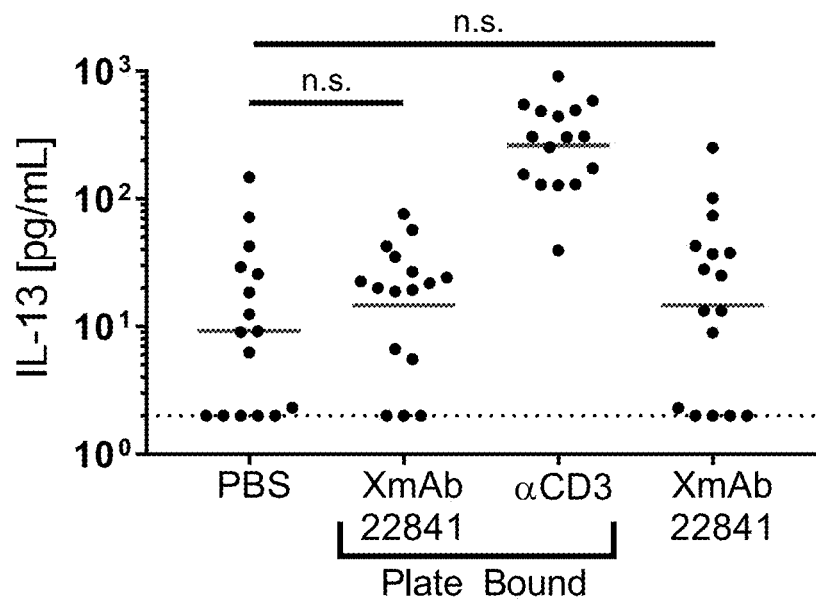
Figure 106J:
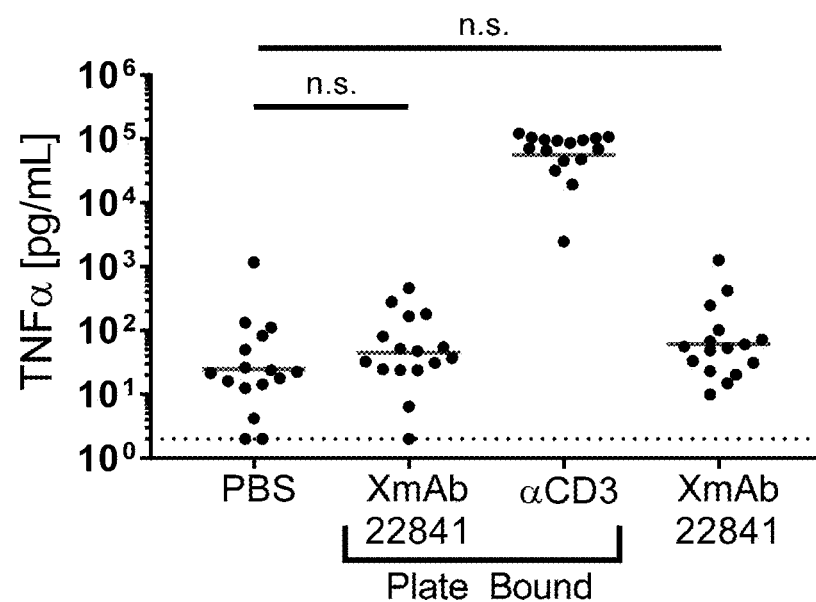
Figure 108A:
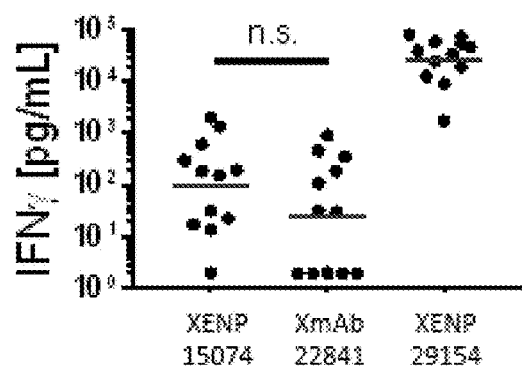
Figure 108B:
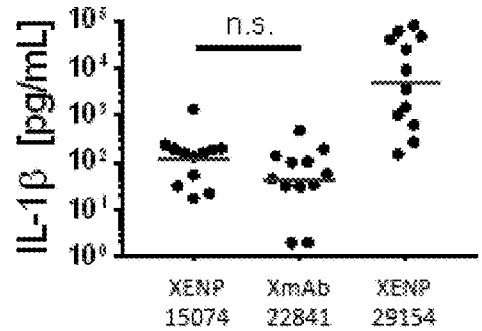
Figure 108C:
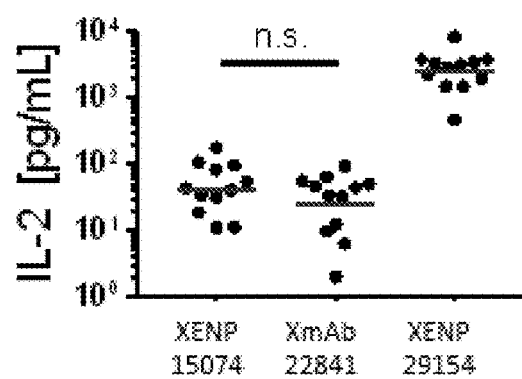
Figure 108D:
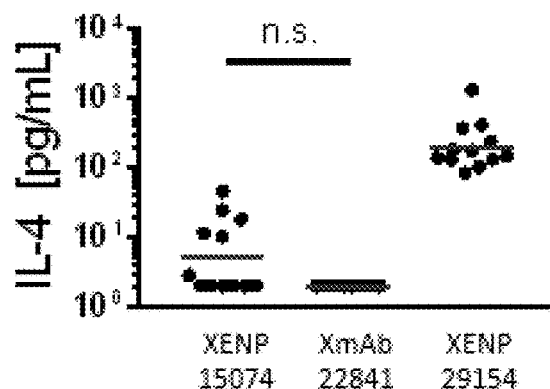
Figure 108E:
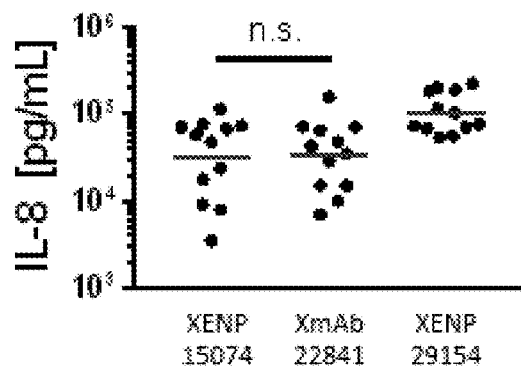
Figure 108F:
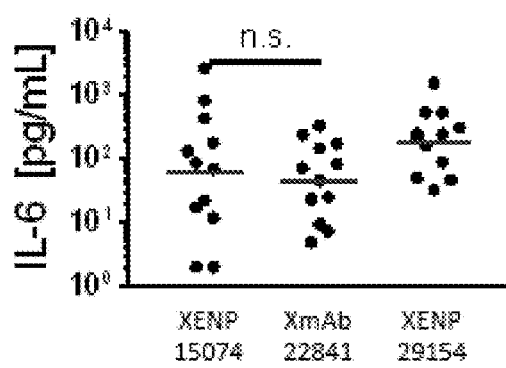
Figure 108G:
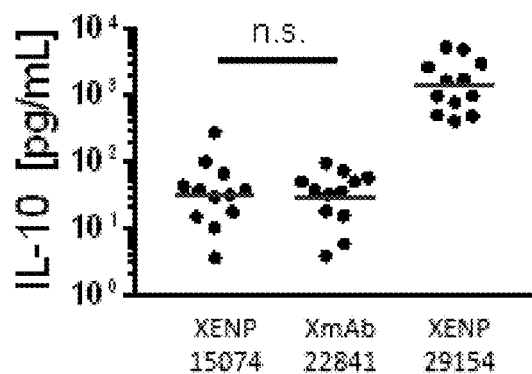
Figure 108H:
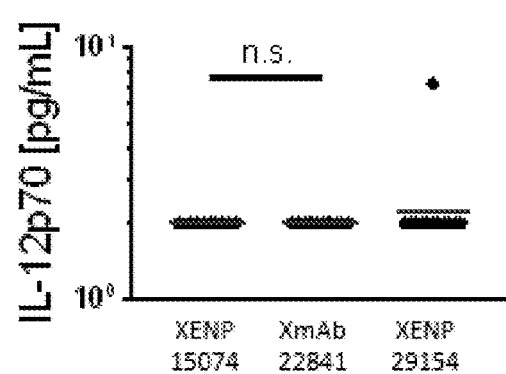
Figure 108I:
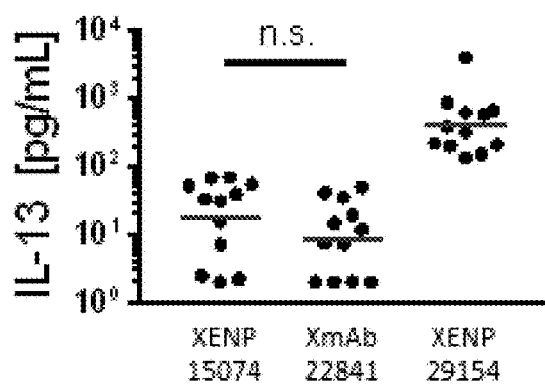
Figure 108J:
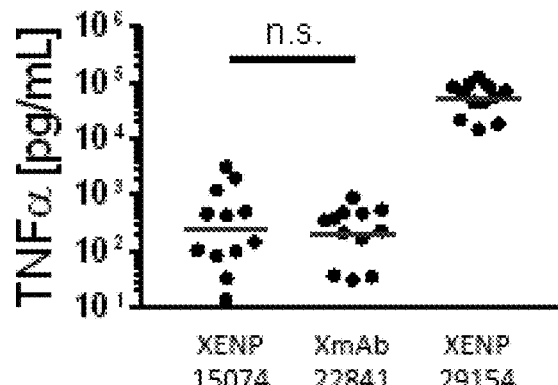

FIG. 105 depicts the EC₅₀ of pembrolizumab for blocking XmAb20717 binding to PD-1⁺CTLA-4⁺ cells. EC₅₀ values were derived from Prism software with curve fits using a least squares method.

FIGS. 106A to 106J depict the release of A) IFNγ, B) IL-1ß, C) IL-2, D) IL-4, E) IL-8, F) IL-6, G) IL-10, H) IL-12p70, I) IL-13, and J) TNFα from human PBMCs treated with PBS, plate-bound XmAb22841, soluble XmAb22841, and plate-bound anti-CD3 antibody (OKT3).

FIG. 107 depicts the sequences for XENP29154, which is in-house produced TGN1412.

FIGS. 108A to 108J depict the release of A) IFNγ, B) IL-1ß, C) IL-2, D) IL-4, E) IL-8, F) IL-6, G) IL-10, H) IL-12p70, I) IL-13, and J) TNFα from human PBMCs treated with air-dried XmAb22841, air-dried XENP15074 (isotype control), and air-dried XENP29154 (positive control).

Figure 109A:
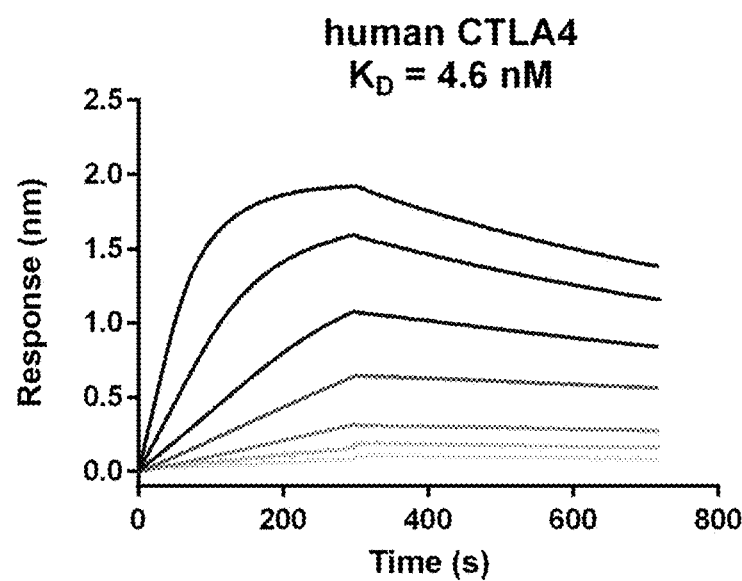
Figure 109B:
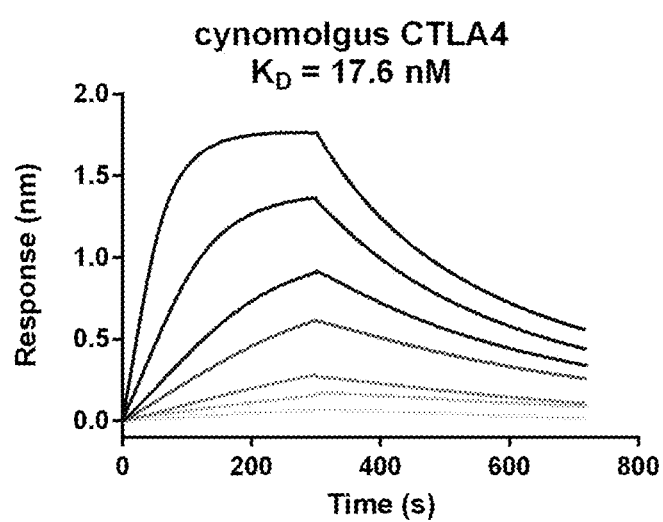

FIGS. 109A and 109B depict sensorgrams showing binding of XmAb22841 to A) human CTLA-4 and B) cynomolgus CTLA-4.

Figure 110A:
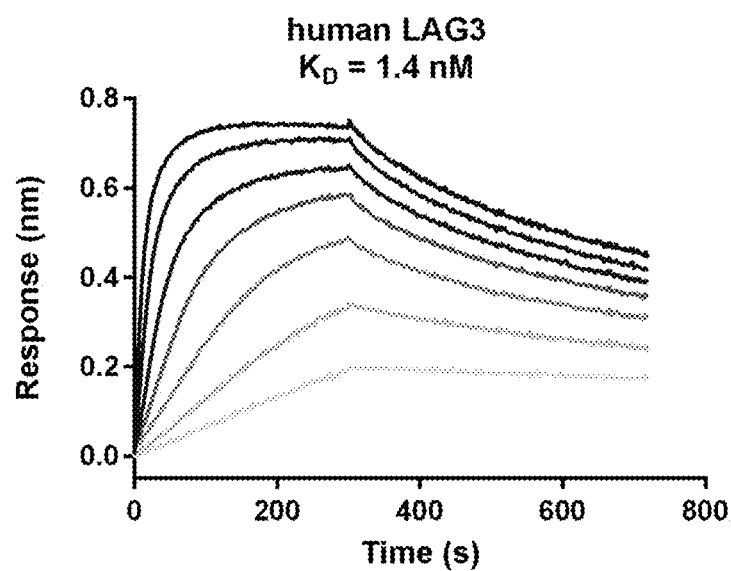
Figure 110B:
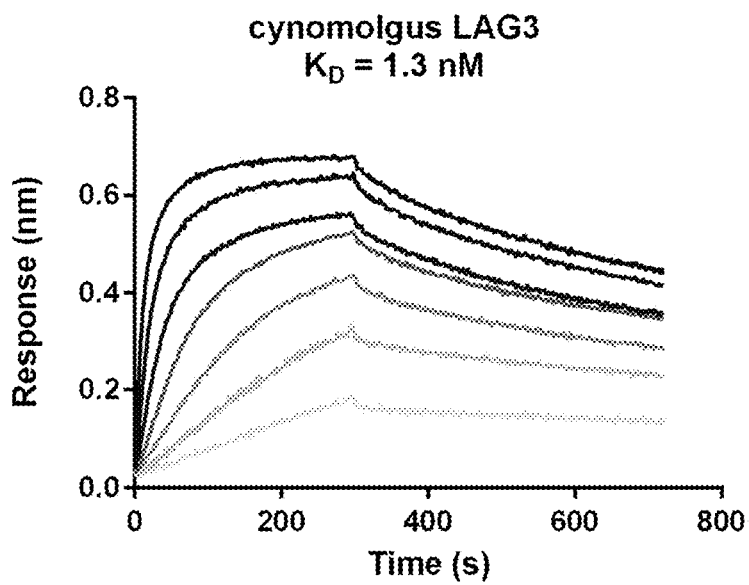

FIGS. 110A and 110B depict sensorgrams showing binding of XmAb22841 to A) human LAG-3 and B) cynomolgus LAG-3.

FIG. 111 depicts the equilibrium dissociation constants (KD), association rates ($k_a$), and dissociation rates ($k_d$) for binding of XmAb22841 to human and cynomolgus CTLA-4 and LAG-3.

Figure 112:
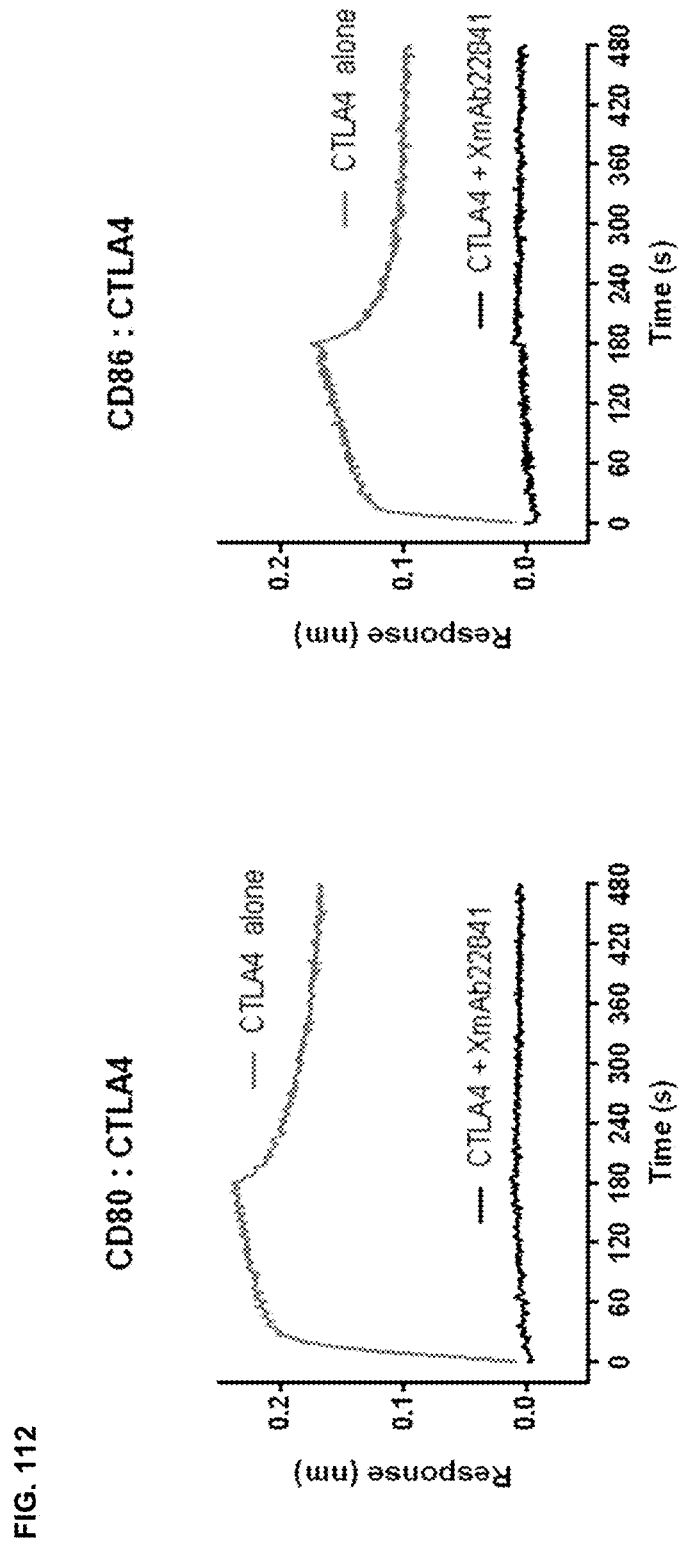

FIG. 112 depicts sensorgrams from competition binding experiments of CTLA-4 and ligands CD80 and CD86 with and without XmAb22841 pre-incubation.

Figure 113:
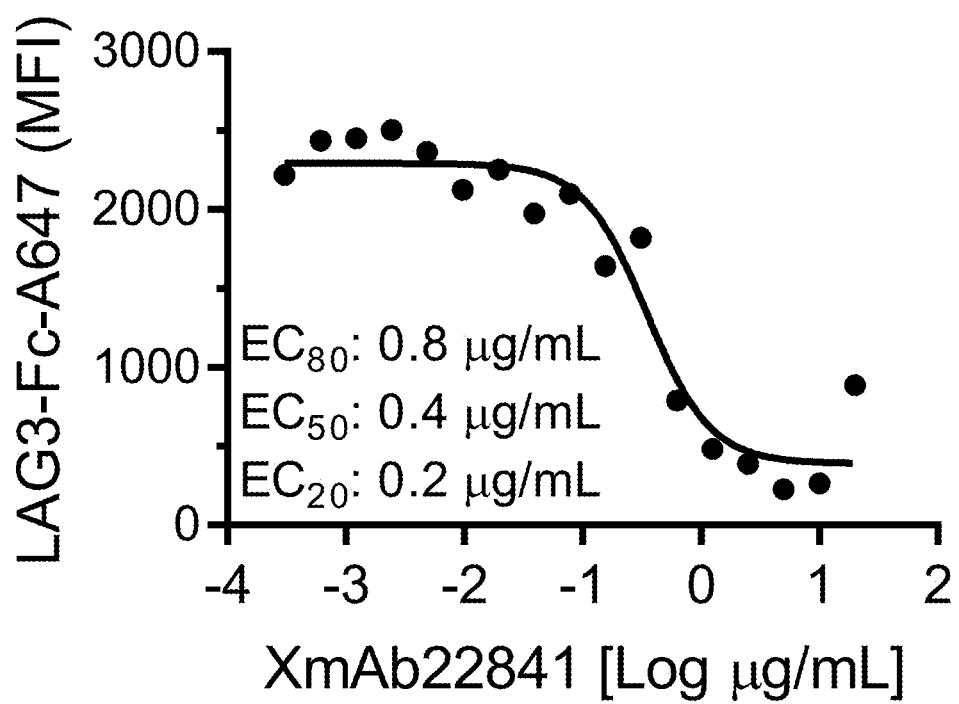

FIG. 113 depicts blocking of soluble LAG-3-Fc binding to cell-surface MHC Class II on Ramos cells by XmAb22841.

Figure 114:
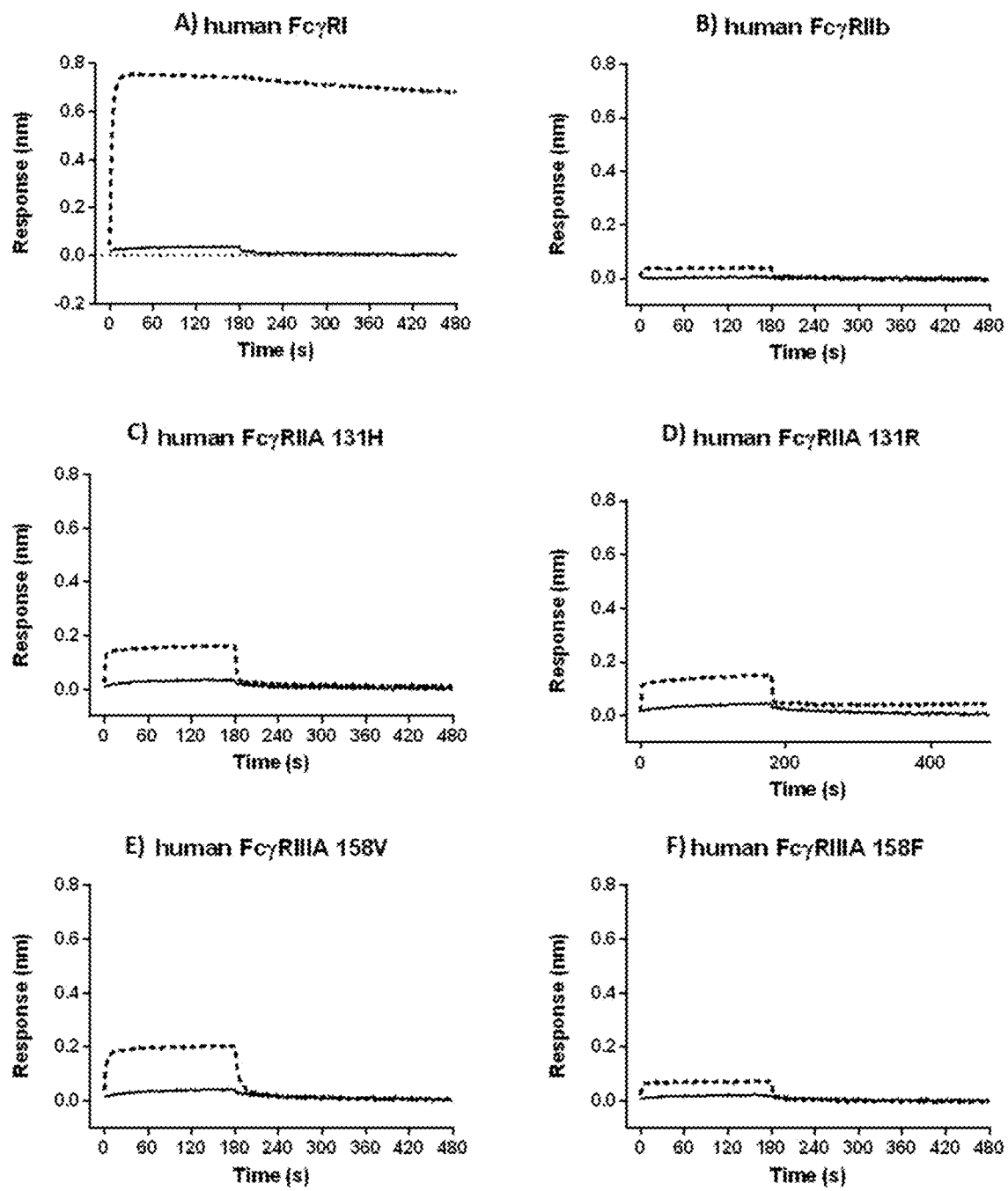

FIG. 114 depicts sensorgrams showing binding of XmAb22841 (solid line) and human IgG comparator (an anti-CD19 antibody with a native IgG1 constant region; dotted line) to A) human FcγRI, B) human FcγRIIb, C) human FcγRIIA (131H), D) human FcγRIIA (131R), E) human FcγRIIIA (158V), and F) human FcγRIIIA (158F).

Figure 115:
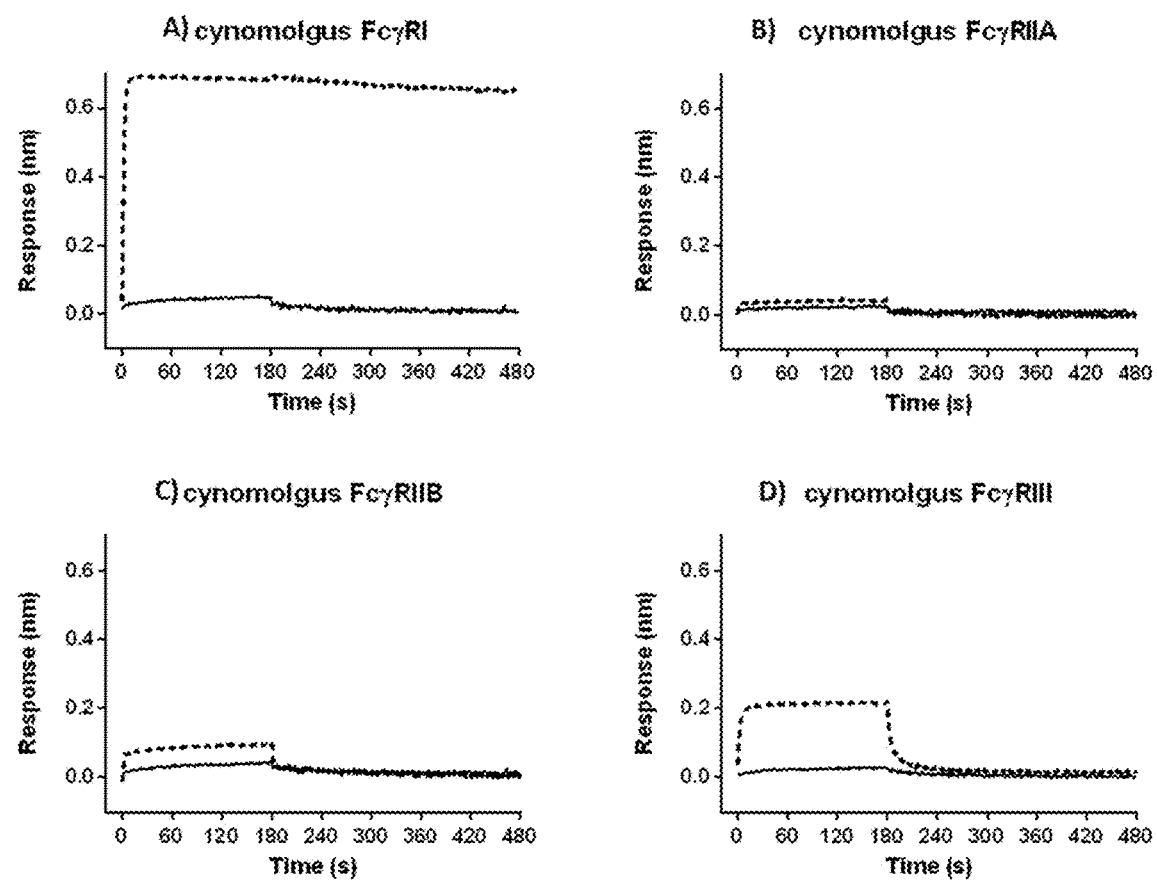

FIG. 115 depicts sensorgrams showing binding of XmAb22841 (solid line) and human IgG comparator (an anti-CD19 antibody with a native IgG1 constant region; dotted line) to A) cynomolgus FcγRI, B) cynomolgus FcγRIIA, C) cynomolgus FcγRIIb, and D) cynomolgus RcγRIIIA.

Figure 116:
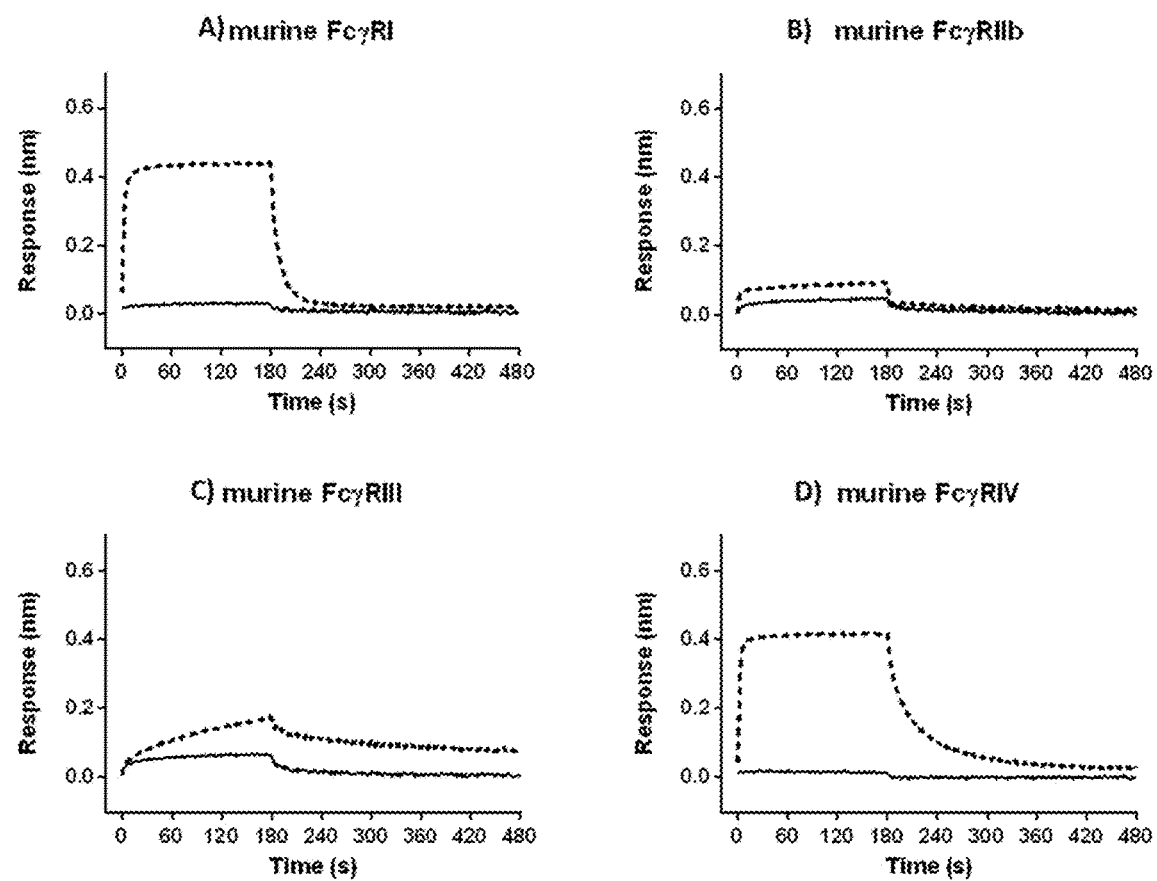

FIG. 116 depicts sensorgrams showing binding of XmAb22841 (solid line) and human IgG comparator (an anti-CD19 antibody with a native IgG1 constant region; dotted line) to A) murine FcγRI, B) murine FcγRIIb, C) murine FcγRIII, and D) murine FcγRIV.

FIG. 117 depicts equilibrium dissociation constants ($K_D$) for binding of XmAb22841 and XENP22602 to human, cynomolgus, and mouse FcRn at pH 6.0.

Figure 118:
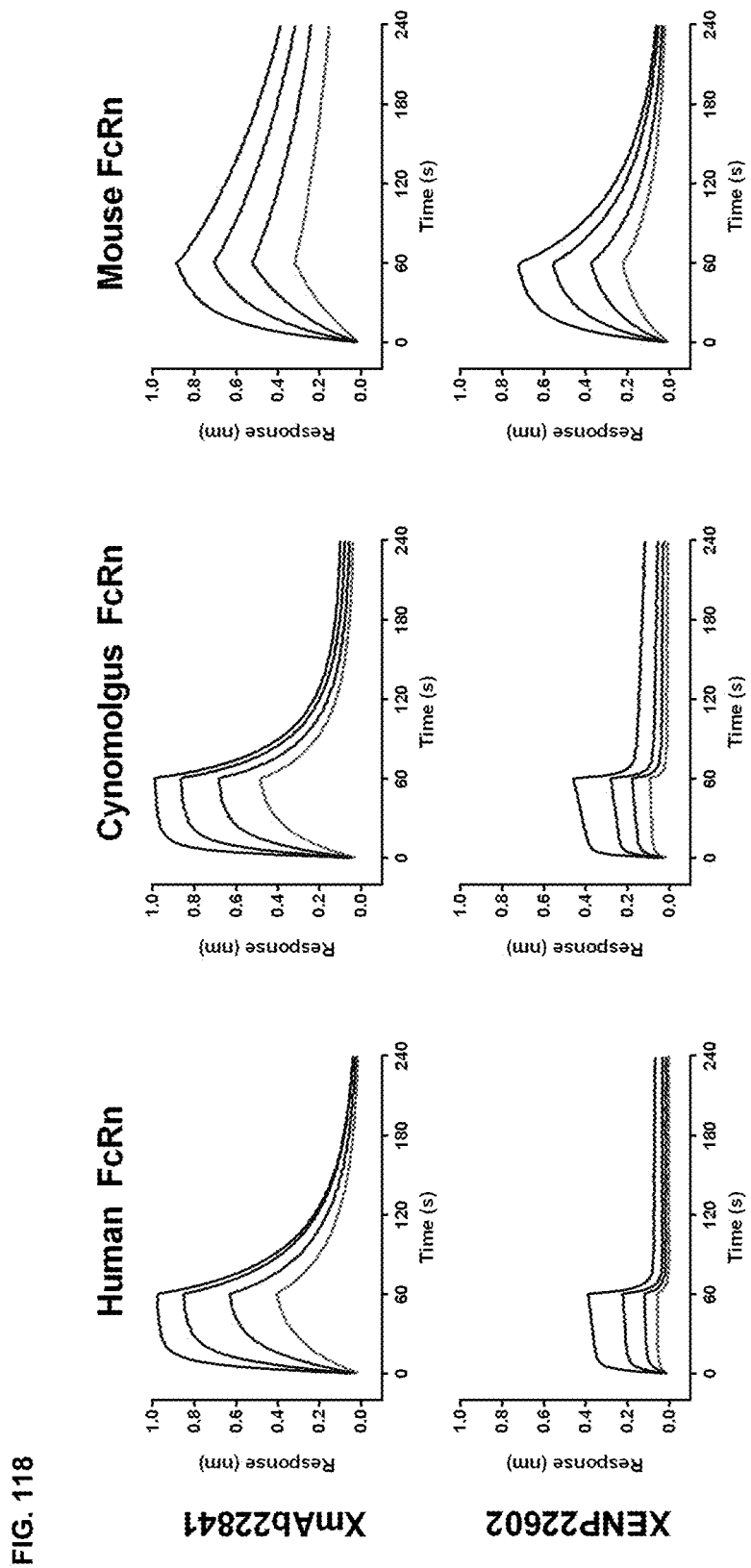

FIG. 118 depicts sensorgrams showing binding of XmAb22841 and XENP22602 to human, cynomolgus, and mouse FcRn (1000, 500, 250, and 125 nM) at pH 6.0.

Figure 119:
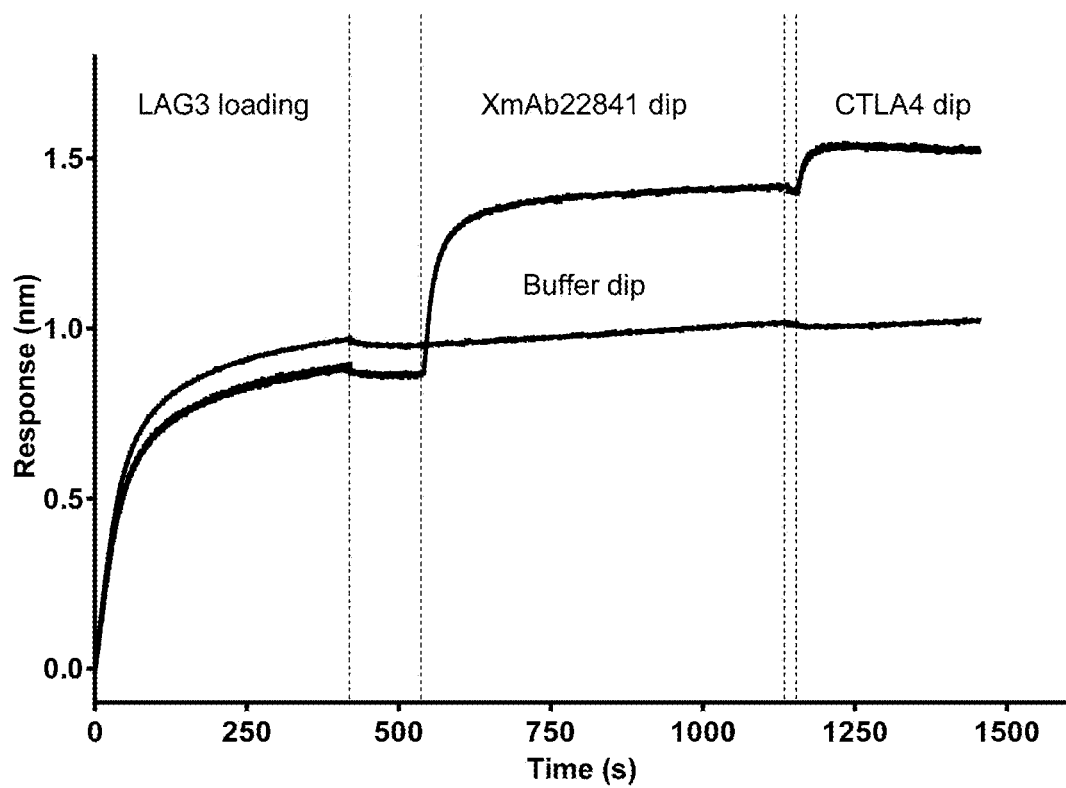

FIG. 119 depicts in-tandem BLI experiment showing biosensors loaded with LAG-3 and dipped into XmAb22841 or buffer followed by a final dip into CTLA-4 antigen.

Figure 120:
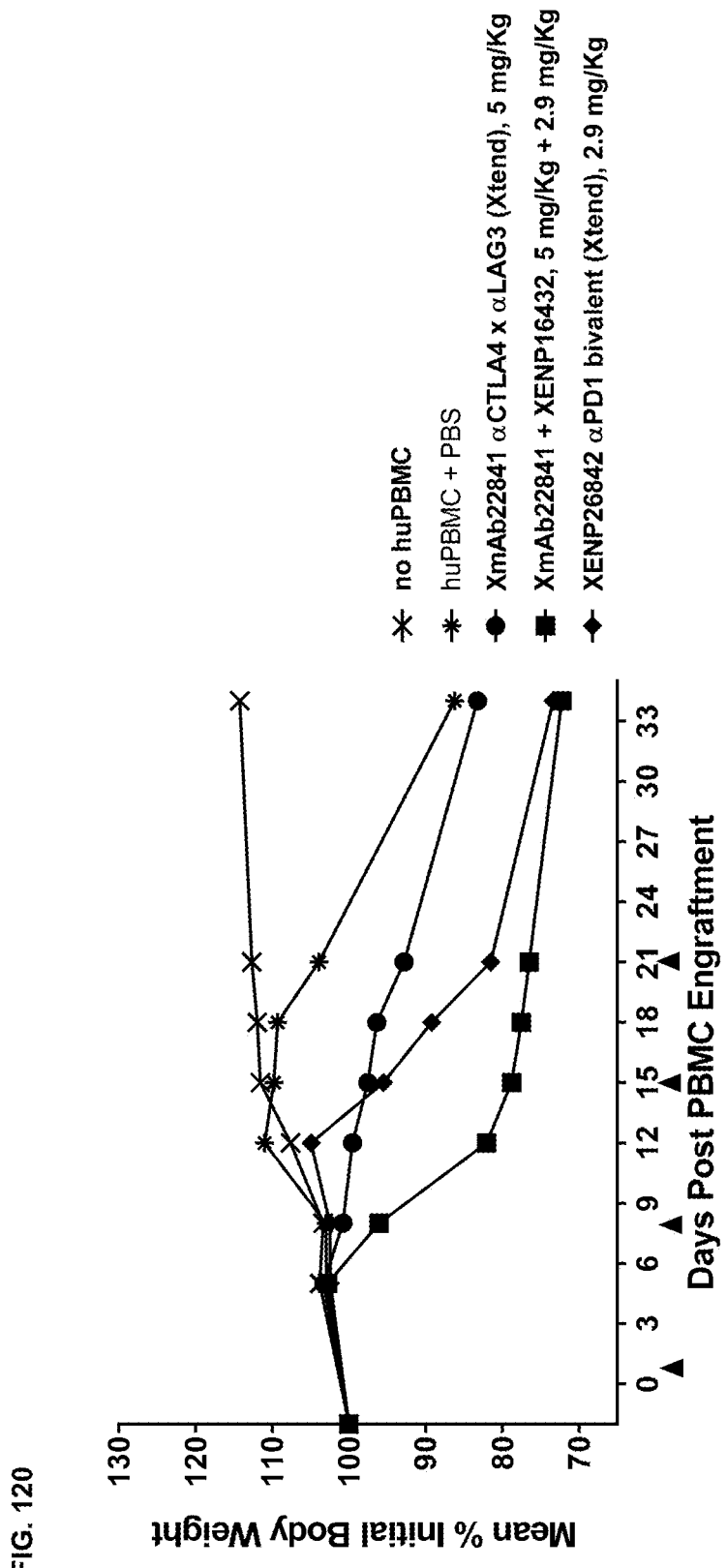

FIG. 120 depicts changes in body weight over time (as a percentage of initial body weight) in NSG mice engrafted i.v. OSP with human PBMCs and dosed with the indicated test articles. Dead mice were set to 70% initial body weight.

Figure 121:
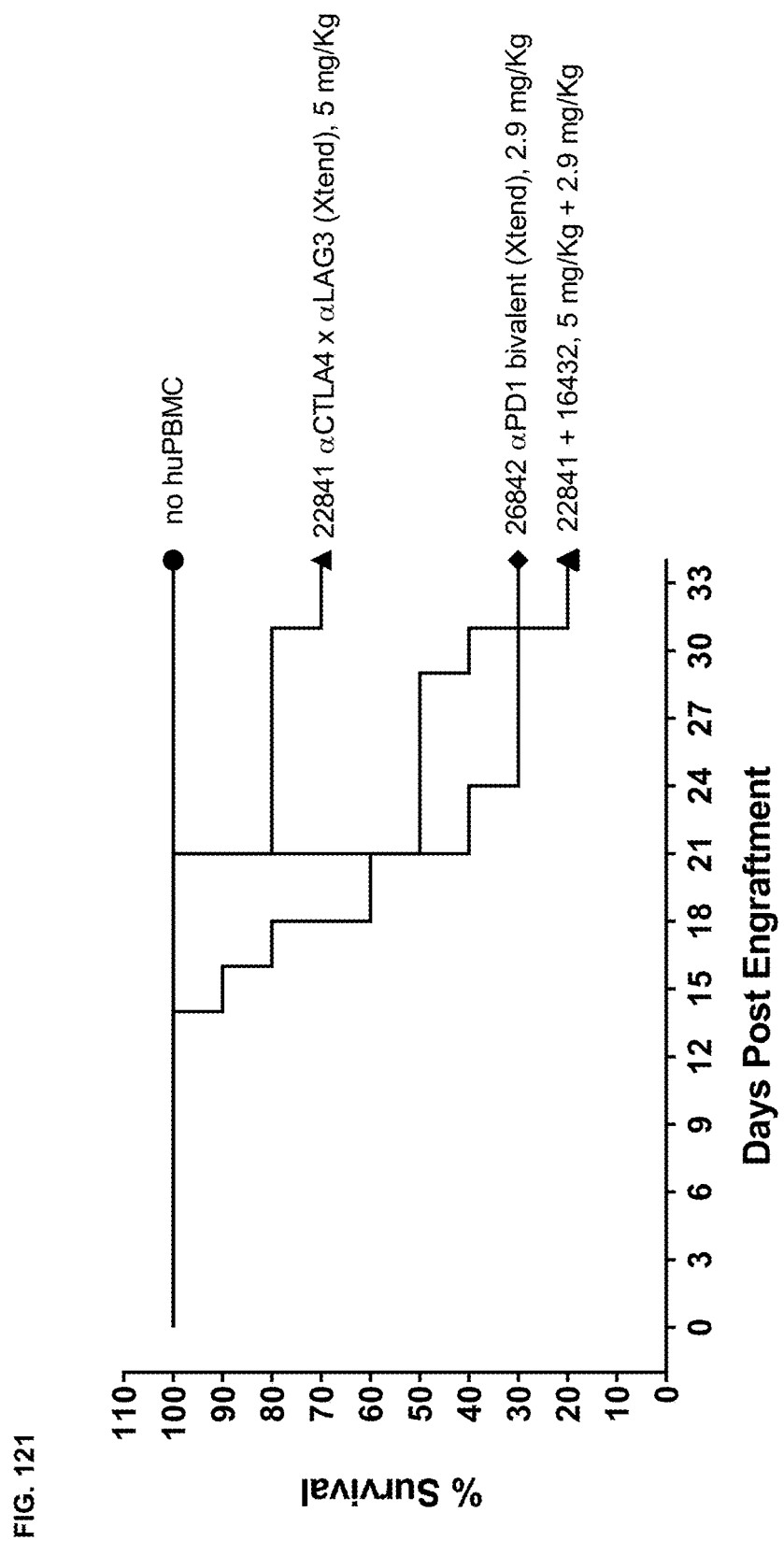

FIG. 121 depicts the survival of NSG mice engrafted i.v. OSP with human PBMCs and dosed with the indicated test articles.

Figure 122A:
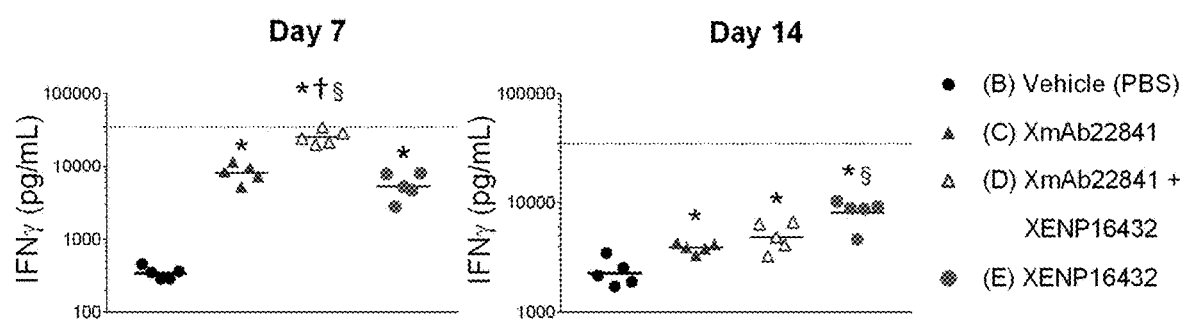
Figure 122B:
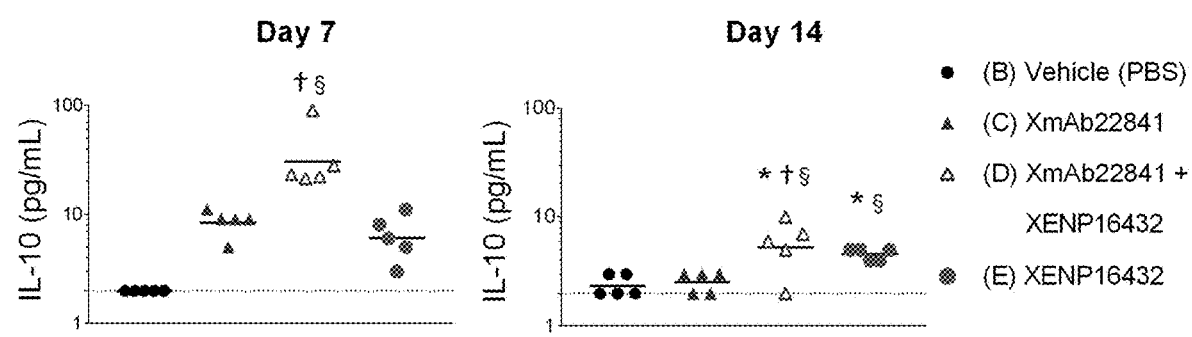

FIGS. 122A and 122B depict serum A) IFNγ concentration and B) IL-10 concentrations on Days 7 and 14 in serum of NSG mice engrafted i.v. OSP with human PBMCs and dosed with the indicated test articles.

VI. DETAILED DESCRIPTION OF THE INVENTION

A. Incorporation of Materials

1. Figures and Legends

All the figures, accompanying legends and sequences (with their identifiers and/or descriptions) of United States Patent Application Nos. 62/583,438, filed Nov. 8, 2017; 62/598,938, filed Dec. 14, 2017; 62/658,227, filed Apr. 16, 2018; 62/420,500, filed Nov. 10, 2016; 62/353,511, filed Jun. 22, 2016; 62/350,145, filed Jun. 14, 2016, Ser. No. 15/623,314, filed Jun. 14, 2017 and PCT/US17/37555, filed Jun. 14, 2017, all which are expressly and independently incorporated by reference herein in their entirety, particularly for the amino acid sequences depicted therein.

2. Sequences

Reference is made to the accompanying sequence listing as following: anti-PD-1 sequences suitable for use as ABDs include SEQ ID NOs: 6209-11464 (PD-1 scFv sequences, although the Fv sequences therein can be formatted as Fabs), SEQ ID NOs: 11465-17134 (PD-1 Fab sequences, although the Fv sequences therein can be formatted as scFvs), SEQ ID NOs: 33003-33072 (additional PD-1 Fab sequences, although the Fv sequences therein can be formatted as scFvs), SEQ ID NOs: 33073-35394 (additional PD-1 scFv sequences, although the Fv sequences therein can be formatted as Fabs) and SEQ ID NOs: 36127-36146 (PD-1 bivalent constructs, which can be formatted as either scFvs or Fabs). Anti-CTLA-4 sequences suitable for use as ABDs include SEQ ID NOs: 21-2918 (CTLA-4 scFv sequences, although the Fv sequences therein can be formatted as Fabs), SEQ ID NOs: 2919-6208 (CTLA-4 Fab sequences, although the Fv sequences therein can be formatted as scFvs), SEQ ID NOs: 36739-36818 (additional CTLA-4 Fab sequences, although the Fv sequences therein can be formatted as scFvs) and SEQ ID NOs: 35395-35416 (CTLA-4 one armed constructs, which can be formatted as either Fabs or scFvs). Anti-LAG-3 sequences suitable for use as ABDs include SEQ ID NOs: 17135-20764 (LAG-3 Fabs, although the Fv sequences therein can be formatted as scFvs), SEQ ID NOs:

36819-36962 (additional LAG-3 Fabs although the Fv sequences therein can be formatted as scFvs), SEQ ID NOs: 35417-35606 (additional LAG-3 Fabs although the Fv sequences therein can be formatted as scFvs), SEQ ID NOs: 25194-32793 (additional LAG-3 Fabs although the Fv sequences therein can be formatted as scFvs) and SEQ ID NOs: 32794-33002 (one armed LAG-3 constructs which can be formatted as either Fabs or scFvs). Anti-TIM-3 sequences suitable for use as ABDs include SEQ ID NOs: 20765-20884 (TIM-3 Fabs, although the Fv sequences therein can be formatted as scFvs), SEQ ID NOs: 37587-37698 (additional TIM-3 Fabs, the Fv sequences therein can be formatted as scFvs) and SEQ ID NOs: 36347-36706 (bivalent TIM-3 constructs which can be formatted as either Fabs or scFvs). Anti-BTLA sequences suitable for use as ABDs include SEQ ID NOs: 20885-21503 (BTLA Fabs although the Fv sequences therein can be formatted as scFvs) and SEQ ID NOs: 36707-36738 (additional BTLA Fabs although the Fv sequences therein can be formatted as scFvs). Anti-TIGIT sequences suitable for use as ABDs include SEQ ID NOs: 21504-21523 (TIGIT Fab although the Fv sequences therein can be formatted as scFvs) and SEQ ID NOs: 37435-37586 (additional TIGIT Fabs although the Fv sequences therein can be formatted as scFvs). As will be understood from those in the art, these sequence identifiers come in "pairs" for the variable heavy and light chains, as will be apparent from the sequence identifiers.

Bispecific antibodies of the invention include LAG3 X CTLA4 constructs of SEQ ID NOs: 35607-35866 and SEQ ID NOs: 21524-22620. PD-1 X CTLA4 constructs include those listed as SEQ ID NOs: 36167-36346 and SEQ ID NOs: 23316-23735. PD-1 X TIM3 constructs include those listed as SEQ ID NOs: 25174-25193. PD-1 X LAG3 constructs include those listed as SEQ ID NOs: 35867-36126 and SEQ ID NOs: 23736-25133. PD-1 X TIGIT constructs include those listed as SEQ ID NOs: 25134-25173. PD-1 X BTLA constructs include those listed as SEQ ID NOs: 22724-23315 and SEQ ID NOs: 36147-36166. CTLA4 X BTLA constructs include those listed as SEQ ID NOs: 22624-22723. Finally, the names for XENP23552, XENP22841, XENP22842, XENP22843, XENP22844, XENP22845, XENP22846, XENP22847, XENP22848, XENP22849, XENP22850, XENP22851, XENP22852, XENP22858, XENP22854, XENP22855 all should have included the "M428L/N434S" notation in the title, which were inadvertantly left off.

B. Nomenclature

The bispecific antibodies of the invention are listed in several different formats. Each polypeptide is given a unique "XENP" number (or in some cases, a "XENCS" number), although as will be appreciated in the art, a longer sequence might contain a shorter one. For example, the heavy chain of the scFv side monomer of a bottle opener format for a given sequence will have a first XENP number, while the scFv domain will have a different XENP number. Some molecules have three polypeptides, so the XENP number, with the components, is used as a name. Thus, the molecule XENP20717, which is in bottle opener format, comprises three sequences, generally referred to as "XENP20717 HC-Fab", XENP20717 HC-scFv" and "XENP20717 LC" or equivalents, although one of skill in the art would be able to identify these easily through sequence alignment. These XENP numbers are in the sequence listing as well as identifiers, and used in the Figures. In addition, one molecule, comprising the three components, gives rise to multiple sequence identifiers. For example, the listing of the Fab monomer has the full length sequence, the variable heavy sequence and the three CDRs of the variable heavy sequence; the light chain has a full length sequence, a variable light sequence and the three CDRs of the variable light sequence; and the scFv-Fc domain has a full length sequence, an scFv sequence, a variable light sequence, 3 light CDRs, a scFv linker, a variable heavy sequence and 3 heavy CDRs; note that all molecules herein with a scFv domain use a single charged scFv linker (+H), although others can be used. In addition, the naming nomenclature of particular variable domains uses a "Hx.xx_Ly.yy" type of format, with the numbers being unique identifiers to particular variable chain sequences. Thus, the variable domain of the Fab side of XENP22841 is "7G8_H3.30_L1.34", which indicates that the variable heavy domain H3.30 was combined with the light domain L1.34. In the case that these sequences are used as scFvs, the designation "7G8_H3.30_L1.34", indicates that the variable heavy domain H3.30 was combined with the light domain L1.34 and is in vh-linker-vl orientation, from N- to C-terminus. This molecule with the identical sequences of the heavy and light variable domains but in the reverse order would be named "7G8_L1.34_H3.30". Similarly, different constructs may "mix and match" the heavy and light chains as will be evident from the sequence listing and the Figures.

C. Definitions

In order that the application may be more completely understood, several definitions are set forth below. Such definitions are meant to encompass grammatical equivalents.

By "ablation" herein is meant a decrease or removal of activity. Thus for example, "ablating FcγR binding" means the Fc region amino acid variant has less than 50% starting binding as compared to an Fc region not containing the specific variant, with more than 70-80-90-95-98% loss of activity being preferred, and in general, with the activity being below the level of detectable binding in a Biacore, SPR or BLI assay. Of particular use in the ablation of FcγR binding are those shown in FIG. 5, which generally are added to both monomers.

By "ADCC" or "antibody dependent cell-mediated cytotoxicity" as used herein is meant the cell-mediated reaction wherein nonspecific cytotoxic cells that express FcγRs recognize bound antibody on a target cell and subsequently cause lysis of the target cell. ADCC is correlated with binding to FcγRIIIa; increased binding to FcγRIIIa leads to an increase in ADCC activity.

By "ADCP" or antibody dependent cell-mediated phagocytosis as used herein is meant the cell-mediated reaction wherein nonspecific phagocytic cells that express FcγRs recognize bound antibody on a target cell and subsequently cause phagocytosis of the target cell.

By "antigen binding domain" or "ABD" herein is meant a set of six Complementary Determining Regions (CDRs) that, when present as part of a polypeptide sequence, specifically binds a target antigen as discussed herein. Thus, a "checkpoint antigen binding domain" binds a target checkpoint antigen as outlined herein. As is known in the art, these CDRs are generally present as a first set of variable heavy CDRs (vhCDRs or VHCDR5) and a second set of variable light CDRs (vhCDRs or VLCDR5), each comprising three CDRs: vhCDR1, vhCDR2, vhCDR3 for the heavy chain and vlCDR1, vlCDR2 and vlCDR3 for the light. The CDRs are present in the variable heavy and variable light domains, respectively, and together form an Fv region. (See Table 1 and related discussion above for CDR numbering schemes). Thus, in some cases, the six CDRs of the antigen binding domain are contributed by a variable heavy and a variable light domain. In a "Fab" format, the set of 6 CDRs are contributed by two different polypeptide sequences, the variable heavy domain (vh or VH; containing the vhCDR1, vhCDR2 and vhCDR3) and the variable light domain (vl or VL; containing the vlCDR1, vlCDR2 and vlCDR3), with the C-terminus of the vh domain being attached to the N-terminus of the CH1 domain of the heavy chain and the C-terminus of the vl domain being attached to the N-terminus of the constant light domain (and thus forming the light chain). In a scFv format, the vh and vl domains are covalently attached, generally through the use of a linker (a "scFv linker") as outlined herein, into a single polypeptide sequence, which can be either (starting from the N-terminus) vh-linker-vl or vl-linker-vh, with the former being generally preferred (including optional domain linkers on each side, depending on the format used (e.g. from FIG. 1A-1O). In general, the C-terminus of the scFv domain is attached to the N-terminus of the hinge in the second monomer.

By "modification" herein is meant an amino acid substitution, insertion, and/or deletion in a polypeptide sequence or an alteration to a moiety chemically linked to a protein. For example, a modification may be an altered carbohydrate or PEG structure attached to a protein. By "amino acid modification" herein is meant an amino acid substitution, insertion, and/or deletion in a polypeptide sequence. For clarity, unless otherwise noted, the amino acid modification is always to an amino acid coded for by DNA, e.g. the 20 amino acids that have codons in DNA and RNA.

By "amino acid substitution" or "substitution" herein is meant the replacement of an amino acid at a particular position in a parent polypeptide sequence with a different amino acid. In particular, in some embodiments, the substitution is to an amino acid that is not naturally occurring at the particular position, either not naturally occurring within the organism or in any organism. For example, the substitution E272Y refers to a variant polypeptide, in this case an Fc variant, in which the glutamic acid at position 272 is replaced with tyrosine. For clarity, a protein which has been engineered to change the nucleic acid coding sequence but not change the starting amino acid (for example exchanging CGG (encoding arginine) to CGA (still encoding arginine) to increase host organism expression levels) is not an "amino acid substitution"; that is, despite the creation of a new gene encoding the same protein, if the protein has the same amino acid at the particular position that it started with, it is not an amino acid substitution.

By "amino acid insertion" or "insertion" as used herein is meant the addition of an amino acid sequence at a particular position in a parent polypeptide sequence. For example, –233E or 233E designates an insertion of glutamic acid after position 233 and before position 234. Additionally, –233ADE or A233ADE designates an insertion of AlaAspGlu after position 233 and before position 234.

By "amino acid deletion" or "deletion" as used herein is meant the removal of an amino acid sequence at a particular position in a parent polypeptide sequence. For example, E233- or E233 #, E233( ) or E233del designates a deletion of glutamic acid at position 233. Additionally, EDA233- or EDA233 # designates a deletion of the sequence GluAspAla that begins at position 233.

By "variant protein" or "protein variant", or "variant" as used herein is meant a protein that differs from that of a parent protein by virtue of at least one amino acid modification. The protein variant has at least one amino acid modification compared to the parent protein, yet not so many that the variant protein will not align with the parental protein using an alignment program such as that described below. In general, variant proteins (such as variant Fc domains, etc., outlined herein, are generally at least 75, 80, 85, 90, 91, 92, 93, 94, 95, 96, 97, 98 or 99% identical to the parent protein, using the alignment programs described below, such as BLAST.

As described below, in some embodiments the parent polypeptide, for example an Fc parent polypeptide, is a human wild type sequence, such as the heavy constant domain or Fc region from IgG1, IgG2, IgG3 or IgG4, although human sequences with variants can also serve as "parent polypeptides", for example the IgG1/2 hybrid of US Publication 2006/0134105 can be included. The protein variant sequence herein will preferably possess at least about 80% identity with a parent protein sequence, and most preferably at least about 90% identity, more preferably at least about 95-98-99% identity. Accordingly, by "antibody variant" or "variant antibody" as used herein is meant an antibody that differs from a parent antibody by virtue of at least one amino acid modification, "IgG variant" or "variant IgG" as used herein is meant an antibody that differs from a parent IgG (again, in many cases, from a human IgG sequence) by virtue of at least one amino acid modification, and "immunoglobulin variant" or "variant immunoglobulin" as used herein is meant an immunoglobulin sequence that differs from that of a parent immunoglobulin sequence by virtue of at least one amino acid modification. "Fc variant" or "variant Fc" as used herein is meant a protein comprising an amino acid modification in an Fc domain as compared to an Fc domain of human IgG1, IgG2 or IgG4.

The Fc variants of the present invention are defined according to the amino acid modifications that compose them. Thus, for example, N434S or 434S is an Fc variant with the substitution serine at position 434 relative to the parent Fc polypeptide, wherein the numbering is according to the EU index. Likewise, M428L/N434S defines an Fc variant with the substitutions M428L and N434S relative to the parent Fc polypeptide. The identity of the WT amino acid may be unspecified, in which case the aforementioned variant is referred to as 428L/434S. It is noted that the order in which substitutions are provided is arbitrary, that is to say that, for example, N434S/M428L is the same Fc variant as M428L/N434S, and so on. For all positions discussed in the present invention that relate to antibodies, unless otherwise noted, amino acid position numbering is according to the EU index. The EU index or EU index as in Kabat or EU numbering scheme refers to the numbering of the EU antibody. Kabat et al. collected numerous primary sequences of the variable regions of heavy chains and light chains. Based on the degree of conservation of the sequences, they classified individual primary sequences into the CDR and the framework and made a list thereof (see SEQUENCES OF IMMUNOLOGICAL INTEREST, 5th edition, NIH publication, No. 91-3242, E. A. Kabat et al., entirely incorporated by reference). See also Edelman et al., 1969, Proc Natl Acad Sci USA 63:78-85, hereby entirely incorporated by reference. The modification can be an addition, deletion, or substitution.

By "protein" herein is meant at least two covalently attached amino acids, which includes proteins, polypeptides, oligopeptides and peptides. In addition, polypeptides that make up the antibodies of the invention may include synthetic derivatization of one or more side chains or termini, glycosylation, PEGylation, circular permutation, cyclization, linkers to other molecules, fusion to proteins or protein domains, and addition of peptide tags or labels.

By "residue" as used herein is meant a position in a protein and its associated amino acid identity. For example, Asparagine 297 (also referred to as Asn297 or N297) is a residue at position 297 in the human antibody IgG1.

By "Fab" or "Fab region" as used herein is meant the polypeptide that comprises the VH, CH1, VL, and CL immunoglobulin domains, generally on two different polypeptide chains (e.g. VH-CH1 on one chain and VL-CL on the other). Fab may refer to this region in isolation, or this region in the context of a bispecific antibody of the invention. In the context of a Fab, the Fab comprises an Fv region in addition to the CH1 and CL domains.

By "Fv" or "Fv fragment" or "Fv region" as used herein is meant a polypeptide that comprises the VL and VH domains of an ABD. Fv regions can be formatted as both Fabs (as discussed above, generally two different polypeptides that also include the constant regions as outlined above) and scFvs, where the vl and vh domains are combined (generally with a linker as discussed herein) to form an scFv.

By "single chain Fv" or "scFv" herein is meant a variable heavy domain covalently attached to a variable light domain, generally using a scFv linker as discussed herein, to form a scFv or scFv domain. A scFv domain can be in either orientation from N- to C-terminus (vh-linker-vl or vl-linker-vh). In the sequences depicted in the sequence listing and in the figures, the order of the vh and vl domain is indicated in the name, e.g. H.X_L.Y means N- to C-terminal is vh-linker-vl, and L.Y_H.X is vl-linker-vh.

By "IgG subclass modification" or "isotype modification" as used herein is meant an amino acid modification that converts one amino acid of one IgG isotype to the corresponding amino acid in a different, aligned IgG isotype. For example, because IgG1 comprises a tyrosine and IgG2 a phenylalanine at EU position 296, a F296Y substitution in IgG2 is considered an IgG subclass modification.

By "non-naturally occurring modification" as used herein is meant an amino acid modification that is not isotypic. For example, because none of the human IgGs comprise a serine at position 434, the substitution 434S in IgG1, IgG2, IgG3, or IgG4 (or hybrids thereof) is considered a non-naturally occurring modification.

By "amino acid" and "amino acid identity" as used herein is meant one of the 20 naturally occurring amino acids that are coded for by DNA and RNA.

By "effector function" as used herein is meant a biochemical event that results from the interaction of an antibody Fc region with an Fc receptor or ligand. Effector functions include but are not limited to ADCC, ADCP, and CDC.

By "IgG Fc ligand" as used herein is meant a molecule, preferably a polypeptide, from any organism that binds to the Fc region of an IgG antibody to form an Fc/Fc ligand complex. Fc ligands include but are not limited to FcγRIs, FcγRIIs, FcγRIIIs, FcRn, C1q, C3, mannan binding lectin, mannose receptor, staphylococcal protein A, streptococcal protein G, and viral FcγR. Fc ligands also include Fc receptor homologs (FcRH), which are a family of Fc receptors that are homologous to the FcγRs (Davis et al., 2002, Immunological Reviews 190:123-136, entirely incorporated by reference). Fc ligands may include undiscovered molecules that bind Fc. Particular IgG Fc ligands are FcRn and Fc gamma receptors. By "Fc ligand" as used herein is meant a molecule, preferably a polypeptide, from any organism that binds to the Fc region of an antibody to form an Fc/Fc ligand complex.

By "Fc gamma receptor", "FcγR" or "FcgammaR" as used herein is meant any member of the family of proteins that bind the IgG antibody Fc region and is encoded by an FcγR gene. In humans this family includes but is not limited to FcγRI (CD64), including isoforms FcγRIa, FcγRIb, and FcγRIc; FcγRII (CD32), including isoforms FcγRIIa (including allotypes H131 and R131), FcγRIIb (including FcγRIIb-1 and FcγRIIb-2), and FcγRIIc; and FcγRIII (CD16), including isoforms FcγRIIIa (including allotypes V158 and F158) and FcγRIIIb (including allotypes FcγRIIb-NA1 and FcγRIIb-NA2) (Jefferis et al., 2002, Immunol Lett 82:57-65, entirely incorporated by reference), as well as any undiscovered human FcγRs or FcγR isoforms or allotypes. An FcγR may be from any organism, including but not limited to humans, mice, rats, rabbits, and monkeys. Mouse FcγRs include but are not limited to FcγRT (CD64), FcγRII (CD32), FcγRIII (CD16), and FcγRIII-2 (CD16-2), as well as any undiscovered mouse FcγRs or FcγR isoforms or allotypes.

By "FcRn" or "neonatal Fc Receptor" as used herein is meant a protein that binds the IgG antibody Fc region and is encoded at least in part by an FcRn gene. The FcRn may be from any organism, including but not limited to humans, mice, rats, rabbits, and monkeys. As is known in the art, the functional FcRn protein comprises two polypeptides, often referred to as the heavy chain and light chain. The light chain is beta-2-microglobulin and the heavy chain is encoded by the FcRn gene. Unless otherwise noted herein, FcRn or an FcRn protein refers to the complex of FcRn heavy chain with beta-2-microglobulin. A variety of FcRn variants used to increase binding to the FcRn receptor, and in some cases, to increase serum half-life. An "FcRn variant" is one that increases binding to the FcRn receptor, and suitable FcRn variants are shown below.

By "parent polypeptide" as used herein is meant a starting polypeptide that is subsequently modified to generate a variant. The parent polypeptide may be a naturally occurring polypeptide, or a variant or engineered version of a naturally occurring polypeptide. Accordingly, by "parent immunoglobulin" as used herein is meant an unmodified immunoglobulin polypeptide that is modified to generate a variant, and by "parent antibody" as used herein is meant an unmodified antibody that is modified to generate a variant antibody. It should be noted that "parent antibody" includes known commercial, recombinantly produced antibodies as outlined below. In this context, a "parent Fc domain" will be relative to the recited variant; thus, a "variant human IgG1 Fc domain" is compared to the parent Fc domain of human IgG1, a "variant human IgG4 Fc domain" is compared to the parent Fc domain human IgG4, etc.

By "Fc" or "Fc region" or "Fc domain" as used herein is meant the polypeptide comprising the CH2-CH3 domains of an IgG molecule, and in some cases, inclusive of the hinge. In EU numbering for human IgG1, the CH2-CH3 domain comprises amino acids 231 to 447, and the hinge is 216 to 230. Thus the definition of "Fc domain" includes both amino acids 231-447 (CH2-CH3) or 216-447 (hinge-CH2-CH3), or fragments thereof. An "Fc fragment" in this context may contain fewer amino acids from either or both of the N- and C-termini but still retains the ability to form a dimer with another Fc domain or Fc fragment as can be detected using standard methods, generally based on size (e.g. non-denaturing chromatography, size exclusion chromatography, etc.)

Human IgG Fc domains are of particular use in the present invention, and can be the Fc domain from human IgG1, IgG2 or IgG4.

A "variant Fc domain" contains amino acid modifications as compared to a parental Fc domain. Thus, a "variant human IgG1 Fc domain" is one that contains amino acid modifications (generally amino acid substitutions, although in the case of ablation variants, amino acid deletions are included) as compared to the human IgG1 Fc domain. In general, variant Fc domains have at least about 80, 85, 90, 95, 97, 98 or 99 percent identity to the corresponding parental human IgG Fc domain (using the identity algorithms discussed below, with one embodiment utilizing the BLAST algorithm as is known in the art, using default parameters). Alternatively, the variant Fc domains can have from 1, 2, 3, 4, 5, 6, 7, 8, 9, 10, 11,12, 13, 14, 15, 16, 17, 18, 19 or 20 amino acid modifications as compared to the parental Fc domain. Additionally, as discussed herein, the variant Fc domains herein still retain the ability to form a dimer with another Fc domain as measured using known techniques as described herein, such as non-denaturing gel electrophoresis.

By "heavy chain constant region" herein is meant the CH1-hinge-CH2-CH3 portion of an antibody (or fragments thereof), excluding the variable heavy domain; in EU numbering of human IgG1 this is amino acids 118-447 By "heavy chain constant region fragment" herein is meant a heavy chain constant region that contains fewer amino acids from either or both of the N- and C-termini but still retains the ability to form a dimer with another heavy chain constant region.

By "position" as used herein is meant a location in the sequence of a protein. Positions may be numbered sequentially, or according to an established format, for example the EU index for antibody numbering.

By "target antigen" as used herein is meant the molecule that is bound specifically by the antigen binding domain comprising the variable regions of a given antibody. As discussed below, in the present case the target antigens are checkpoint proteins.

By "strandedness" in the context of the monomers of the heterodimeric antibodies of the invention herein is meant that, similar to the two strands of DNA that "match", heterodimerization variants are incorporated into each monomer so as to preserve the ability to "match" to form heterodimers. For example, if some pI variants are engineered into monomer A (e.g. making the pI higher) then steric variants that are "charge pairs" that can be utilized as well do not interfere with the pI variants, e.g. the charge variants that make a pI higher are put on the same "strand" or "monomer" to preserve both functionalities. Similarly, for "skew" variants that come in pairs of a set as more fully outlined below, the skilled artisan will consider pI in deciding into which strand or monomer one set of the pair will go, such that pI separation is maximized using the pI of the skews as well.

By "target cell" as used herein is meant a cell that expresses a target antigen.

By "host cell" in the context of producing a bispecific antibody according to the invention herein is meant a cell that contains the exogeneous nucleic acids encoding the components of the bispecific antibody and is capable of expressing the bispecific antibody under suitable conditions. Suitable host cells are discussed below.

By "variable region" or "variable domain" as used herein is meant the region of an immunoglobulin that comprises one or more Ig domains substantially encoded by any of the Vκ, Vλ, and/or VH genes that make up the kappa, lambda, and heavy chain immunoglobulin genetic loci respectively, and contains the CDRs that confer antigen specificity. Thus, a "variable heavy domain" pairs with a "variable light domain" to form an antigen binding domain ("ABD"). In addition, each variable domain comprises three hypervariable regions ("complementary determining regions," "CDRs") (vhCDR1, vhCDR2 and vhCDR3 for the variable heavy domain and vlCDR1, vlCDR2 and vlCDR3 for the variable light domain) and four framework (FR) regions, arranged from amino-terminus to carboxy-terminus in the following order: FR1-CDR1-FR2-CDR2-FR3-CDR3-FR4.

By "wild type or WT" herein is meant an amino acid sequence or a nucleotide sequence that is found in nature, including allelic variations. A WT protein has an amino acid sequence or a nucleotide sequence that has not been intentionally modified.

The invention provides a number of antibody domains that have sequence identity to human antibody domains. Sequence identity between two similar sequences (e.g., antibody variable domains) can be measured by algorithms such as that of Smith, T. F. & Waterman, M. S. (1981) "Comparison Of Biosequences," Adv. Appl. Math. 2:482 [local homology algorithm]; Needleman, S. B. & Wunsch, CD. (1970) "A General Method Applicable To The Search For Similarities In The Amino Acid Sequence Of Two Proteins," J. Mol. Biol. 48:443 [homology alignment algorithm], Pearson, W. R. & Lipman, D. J. (1988) "Improved Tools For Biological Sequence Comparison," Proc. Natl. Acad. Sci. (U.S.A.) 85:2444 [search for similarity method]; or Altschul, S. F. et al, (1990) "Basic Local Alignment Search Tool," J. Mol. Biol. 215:403-10, the "BLAST" algorithm, see https://blast.ncbi.nlm.nih.gov/Blast.cgi. When using any of the aforementioned algorithms, the default parameters (for Window length, gap penalty, etc) are used. In one embodiment, sequence identity is done using the BLAST algorithm, using default parameters The antibodies of the present invention are generally isolated or recombinant. "Isolated," when used to describe the various polypeptides disclosed herein, means a polypeptide that has been identified and separated and/or recovered from a cell or cell culture from which it was expressed. Ordinarily, an isolated polypeptide will be prepared by at least one purification step. An "isolated antibody," refers to an antibody which is substantially free of other antibodies having different antigenic specificities. "Recombinant" means the antibodies are generated using recombinant nucleic acid techniques in exogenous host cells, and they can be isolated as well.

"Specific binding" or "specifically binds to" or is "specific for" a particular antigen or an epitope means binding that is measurably different from a non-specific interaction. Specific binding can be measured, for example, by determining binding of a molecule compared to binding of a control molecule, which generally is a molecule of similar structure that does not have binding activity. For example, specific binding can be determined by competition with a control molecule that is similar to the target.

Specific binding for a particular antigen or an epitope can be exhibited, for example, by an antibody having a KD for an antigen or epitope of at least about $10^{-4}$M, at least about $10^{-5}$ M, at least about $10^{-6}$M, at least about $10^{-7}$M, at least about $10^{-8}$M, at least about $10^{-9}$M, alternatively at least about $10^{-10}$ M, at least about $10^{-11}$ M, at least about $10^{-12}$M, or greater, where KD refers to a dissociation rate of a particular antibody-antigen interaction. Typically, an antibody that specifically binds an antigen will have a KD that is 20-, 50-, 100-, 500-, 1000-, 5,000-, 10,000- or more times greater for a control molecule relative to the antigen or epitope.

Also, specific binding for a particular antigen or an epitope can be exhibited, for example, by an antibody having a KA or Ka for an antigen or epitope of at least 20-, 50-, 100-, 500-, 1000-, 5,000-, 10,000- or more times greater for the epitope relative to a control, where KA or Ka refers to an association rate of a particular antibody-antigen interaction. Binding affinity is generally measured using a Biacore, SPR or BLI assay.

D. Antibodies

The present invention relates to the generation of bispecific checkpoint antibodies that bind two different checkpoint antigens as discussed herein. As is discussed below, the term "antibody" is used generally. Antibodies that find use in the present invention can take on a number of formats as described herein, including traditional antibodies as well as antibody derivatives, fragments and mimetics, described herein and depicted in the figures.

Traditional antibody structural units typically comprise a tetramer. Each tetramer is typically composed of two identical pairs of polypeptide chains, each pair having one "light" (typically having a molecular weight of about 25 kDa) and one "heavy" chain (typically having a molecular The hypervariable region generally encompasses amino acid residues from about amino acid residues 24-34 (LCDR1; "L" denotes light chain), 50-56 (LCDR2) and 89-97 (LCDR3) in the light chain variable region and around about 31-35B (HCDR1; "H" denotes heavy chain), 50-65 (HCDR2), and 95-102 (HCDR3) in the heavy chain variable region; Kabat et al., SEQUENCES OF PROTEINS OF IMMUNOLOGICAL INTEREST, 5th Ed. Public Health Service, National Institutes of Health, Bethesda, Md. (1991) and/or those residues forming a hypervariable loop (e.g. residues 26-32 (LCDR1), 50-52 (LCDR2) and 91-96 (LCDR3) in the light chain variable region and 26-32 (HCDR1), 53-55 (HCDR2) and 96-101 (HCDR3) in the heavy chain variable region; Chothia and Lesk (1987) J. Mol. Biol. 196:901-917. Specific CDRs of the invention are described below.

As will be appreciated by those in the art, the exact numbering and placement of the CDRs can be different among different numbering systems. However, it should be understood that the disclosure of a variable heavy and/or variable light sequence includes the disclosure of the associated (inherent) CDRs. Accordingly, the disclosure of each variable heavy region is a disclosure of the vhCDRs (e.g. vhCDR1, vhCDR2 and vhCDR3) and the disclosure of each variable light region is a disclosure of the vlCDRs (e.g. vlCDR1, vlCDR2 and vlCDR3). A useful comparison of CDR numbering is as below, see Lafranc et al., Dev. Comp. Immunol. 27(1):55-77 (2003):

TABLE 1

|  | Kabat + Chothia | IMGT | Kabat | AbM | Chothia | Contact | Xencor |
|---|---|---|---|---|---|---|---|
| vhCDR1 | 26-35 | 27-38 | 31-35 | 26-35 | 26-32 | 30-35 | 27-35 |
| vhCDR2 | 50-65 | 56-65 | 50-65 | 50-58 | 52-56 | 47-58 | 54-61 |
| vhCDR3 | 95-102 | 105-117 | 95-102 | 95-102 | 95-102 | 93-101 | 103-116 |
| vlCDR1 | 24-34 | 27-38 | 24-34 | 24-34 | 24-34 | 30-36 | 27-38 |
| vlCDR2 | 50-56 | 56-65 | 50-56 | 50-56 | 50-56 | 46-55 | 56-62 |
| vlCDR3 | 89-97 | 105-117 | 89-97 | 89-97 | 89-97 | 89-96 | 97-105 | weight of about 50-70 kDa). Human light chains are classified as kappa and lambda light chains. The present invention is directed to bispecific antibodies that generally are based on the IgG class, which has several subclasses, including, but not limited to IgG1, IgG2, IgG3, and IgG4. In general, IgG1, IgG2 and IgG4 are used more frequently than IgG3. It should be noted that IgG1 has different allotypes with polymorphisms at 356 (D or E) and 358 (L or M). The sequences depicted herein use the 356E/358M allotype, however the other allotype is included herein. That is, any sequence inclusive of an IgG1 Fc domain included herein can have 356D/358L replacing the 356E/358M allotype.

In addition, many of the antibodies herein have at least one of the cysteines at position 220 replaced by a serine; generally this is the on the "scFv monomer" side for most of the sequences depicted herein, although it can also be on the "Fab monomer" side, or both, to reduce disulfide formation. Specifically included within the sequences herein are one or both of these cysteines replaced (C220S).

Thus, "isotype" as used herein is meant any of the subclasses of immunoglobulins defined by the chemical and antigenic characteristics of their constant regions. It should be understood that therapeutic antibodies can also comprise hybrids of isotypes and/or subclasses. For example, as shown in US Publication 2009/0163699, incorporated by reference, the present invention the use of human IgG1/G2 hybrids.

Throughout the present specification, the Kabat numbering system is generally used when referring to a residue in the variable domain (approximately, residues 1-107 of the light chain variable region and residues 1-113 of the heavy chain variable region) and the EU numbering system for Fc regions (e.g., Kabat et al., supra (1991)).

Another type of Ig domain of the heavy chain is the hinge region. By "hinge" or "hinge region" or "antibody hinge region" or "hinge domain" herein is meant the flexible polypeptide comprising the amino acids between the first and second constant domains of an antibody. Structurally, the IgG CH1 domain ends at EU position 215, and the IgG CH2 domain begins at residue EU position 231. Thus for IgG the antibody hinge is herein defined to include positions 216 (E216 in IgG1) to 230 (p230 in IgG1), wherein the numbering is according to the EU index as in Kabat. In some cases, a "hinge fragment" is used, which contains fewer amino acids at either or both of the N- and C-termini of the hinge domain. As noted herein, pI variants can be made in the hinge region as well.

The light chain generally comprises two domains, the variable light domain (containing the light chain CDRs and together with the variable heavy domains forming the Fv region), and a constant light chain region (often referred to as CL or Cx).

Another region of interest for additional substitutions, outlined herein, is the Fc region.

The present invention provides a large number of different CDR sets. In this case, a "full CDR set" comprises the three variable light and three variable heavy CDRs, e.g. vlCDR1, vlCDR2, vlCDR3, vhCDR1, vhCDR2 and vhCDR3. These can be part of a larger variable light or variable heavy domain, respectfully. In addition, as more fully outlined herein, the variable heavy and variable light domains can be on separate polypeptide chains, when a heavy and light chain is used (for example when Fabs are used), or on a single polypeptide chain in the case of scFv sequences.

The CDRs contribute to the formation of the antigen-binding, or more specifically, epitope binding site of antibodies. "Epitope" refers to a determinant that interacts with a specific antigen binding site in the variable region of an antibody molecule known as a paratope. Epitopes are groupings of molecules such as amino acids or sugar side chains and usually have specific structural characteristics, as well as specific charge characteristics. A single antigen may have more than one epitope.

The epitope may comprise amino acid residues directly involved in the binding (also called immunodominant component of the epitope) and other amino acid residues, which are not directly involved in the binding, such as amino acid residues which are effectively blocked by the specifically antigen binding peptide; in other words, the amino acid residue is within the footprint of the specifically antigen binding peptide.

Epitopes may be either conformational or linear. A conformational epitope is produced by spatially juxtaposed amino acids from different segments of the linear polypeptide chain. A linear epitope is one produced by adjacent amino acid residues in a polypeptide chain. Conformational and nonconformational epitopes may be distinguished in that the binding to the former but not the latter is lost in the presence of denaturing solvents.

An epitope typically includes at least 3, and more usually, at least 5 or 8-10 amino acids in a unique spatial conformation. Antibodies that recognize the same epitope can be verified in a simple immunoassay showing the ability of one antibody to block the binding of another antibody to a target antigen, for example "binning." As outlined below, the invention not only includes the enumerated antigen binding domains and antibodies herein, but those that compete for binding with the epitopes bound by the enumerated antigen binding domains.

Thus, the present invention provides different antibody domains. As described herein and known in the art, the heterodimeric antibodies of the invention comprise different domains within the heavy and light chains, which can be overlapping as well. These domains include, but are not limited to, the Fc domain, the CH1 domain, the CH2 domain, the CH3 domain, the hinge domain, the heavy constant domain (CH1-hinge-Fc domain or CH1-hinge-CH2-CH3), the variable heavy domain, the variable light domain, the light constant domain, Fab domains and scFv domains.

Thus, the "Fc domain" includes the —CH2-CH3 domain, and optionally a hinge domain (—H—CH2-CH3). For IgG, the Fc domain comprises immunoglobulin domains CH2 and CH3 (Cγ2 and Cγ3) and the lower hinge region between CH1 (Cγ1) and CH2 (Cγ2). Although the boundaries of the Fc region may vary, the human IgG heavy chain Fc region is usually defined to include residues C226 or P230 to its carboxyl-terminus, wherein the numbering is according to the EU index as in Kabat. Accordingly, "CH" domains in the context of IgG are as follows: "CH1" refers to positions 118-215 according to the EU index as in Kabat. "Hinge" refers to positions 216-230 according to the EU index as in Kabat. "CH2" refers to positions 231-340 according to the EU index as in Kabat, and "CH3" refers to positions 341-447 according to the EU index as in Kabat. Thus, the "Fc domain" includes the —CH2-CH3 domain, and optionally a hinge domain (hinge-CH2-CH3). In the embodiments herein, when a scFv is attached to an Fc domain, it is generally the C-terminus of the scFv construct that is attached to all or part of the hinge of the Fc domain; for example, it is generally attached to the sequence EPKS which is the beginning of the hinge. In some embodiments, as is more fully described below, amino acid modifications are made to the Fc region, for example to alter binding to one or more FcγR receptors or to the FcRn receptor, and to enable heterodimer formation and purification, as outlined herein.

The heavy chain comprises a variable heavy domain and a constant domain, which includes a CH1-optional hinge-Fc domain comprising a CH2-CH3. The light chain comprises a variable light chain and the light constant domain. A scFv comprises a variable heavy chain, an scFv linker, and a variable light domain. In most of the constructs and sequences outlined herein, the C-terminus of the variable heavy chain is attached to the N-terminus of the scFv linker, the C-terminus of which is attached to the N-terminus of a variable light chain (N-vh-linker-vl-C) although that can be switched (N-vl-linker-vh-C).

Some embodiments of the invention comprise at least one scFv domain, which, while not naturally occurring, generally includes a variable heavy domain and a variable light domain, linked together by a scFv linker. As outlined herein, while the scFv domain is generally from N- to C-terminus oriented as vh-scFv linker-vl, this can be reversed for any of the scFv domains (or those constructed using vh and vl sequences from Fabs), to vl-scFv linker-vh, with optional linkers at one or both ends depending on the format (see generally FIG. 1A-1O).

As shown herein, there are a number of suitable linkers (for use as either domain linkers or scFv linkers) that can be used to covalently attach the recited domains, including traditional peptide bonds, generated by recombinant techniques. In some embodiments, the linker peptide may predominantly include the following amino acid residues: Gly, Ser, Ala, or Thr. The linker peptide should have a length that is adequate to link two molecules in such a way that they assume the correct conformation relative to one another so that they retain the desired activity. In one embodiment, the linker is from about 1 to 50 amino acids in length, preferably about 1 to 30 amino acids in length. In one embodiment, linkers of 1 to 20 amino acids in length may be used, with from about 5 to about 10 amino acids finding use in some embodiments. Useful linkers include glycine-serine polymers, including for example (GS)n, (GSGGS)n (SEQ ID NO: 37756), (GGGGS)n (SEQ ID NO: 37757), and (GGGS)n (SEQ ID NO: 37758), where n is an integer of at least one (and generally from 3 to 4), glycine-alanine polymers, alanine-serine polymers, and other flexible linkers. Alternatively, a variety of nonproteinaceous polymers, including but not limited to polyethylene glycol (PEG), polypropylene glycol, polyoxyalkylenes, or copolymers of polyethylene glycol and polypropylene glycol, may find use as linkers.

Other linker sequences may include any sequence of any length of CL/CH1 domain but not all residues of CL/CH1 domain; for example the first 5-12 amino acid residues of the CL/CH1 domains. Linkers can be derived from immunoglobulin light chain, for example Cκ or Cλ. Linkers can be derived from immunoglobulin heavy chains of any isotype, including for example Cγ1, Cγ2, Cγ3, Cγ4, Cα1, Cα2, Cδ, Cε, and Cμ. Linker sequences may also be derived from other proteins such as Ig-like proteins (e.g. TCR, FcR, KIR), hinge region-derived sequences, and other natural sequences from other proteins.

In some embodiments, the linker is a "domain linker", used to link any two domains as outlined herein together. For example, in FIG. 1F, there may be a domain linker that attaches the C-terminus of the CH1 domain of the Fab to the N-terminus of the scFv, with another optional domain linker attaching the C-terminus of the scFv to the CH2 domain (although in many embodiments the hinge is used as this domain linker). While any suitable linker can be used, many embodiments utilize a glycine-serine polymer as the domain linker, including for example (GS)n, (GSGGS)n (SEQ ID NO: 37756), (GGGGS)n (SEQ ID NO: 37757), and (GGGS)n (SEQ ID NO: 37758), where n is an integer of at least one (and generally from 3 to 4 to 5) as well as any peptide sequence that allows for recombinant attachment of the two domains with sufficient length and flexibility to allow each domain to retain its biological function. In some cases, and with attention being paid to "strandedness", as outlined below, charged domain linkers, as used in some embodiments of scFv linkers can be used.

In some embodiments, the linker is a scFv linker, used to covalently attach the vh and vl domains as discussed herein. In many cases, the scFv linker is a charged scFv linker, a number of which are shown in FIGS. 7A-7B. Accordingly, the present invention further provides charged scFv linkers, to facilitate the separation in pI between a first and a second monomer. That is, by incorporating a charged scFv linker, either positive or negative (or both, in the case of scaffolds that use scFvs on different monomers), this allows the monomer comprising the charged linker to alter the pI without making further changes in the Fc domains. These charged linkers can be substituted into any scFv containing standard linkers. Again, as will be appreciated by those in the art, charged scFv linkers are used on the correct "strand" or monomer, according to the desired changes in pI. For example, as discussed herein, to make triple F format heterodimeric antibody, the original pI of the Fv region for each of the desired antigen binding domains are calculated, and one is chosen to make an scFv, and depending on the pI, either positive or negative linkers are chosen.

Charged domain linkers can also be used to increase the pI separation of the monomers of the invention as well, and thus those included in FIGS. 7A-7B can be used in any embodiment herein where a linker is utilized.

In particular, the formats depicted in FIG. 1 are antibodies, usually referred to as "heterodimeric antibodies", meaning that the protein has at least two associated Fc sequences self-assembled into a heterodimeric Fc domain and at least two Fv regions, whether as Fabs or as scFvs.

E. Chimeric and Humanized Antibodies

In certain embodiments, the antibodies of the invention comprise a heavy chain variable region from a particular germline heavy chain immunoglobulin gene and/or a light chain variable region from a particular germline light chain immunoglobulin gene. For example, such antibodies may comprise or consist of a human antibody comprising heavy or light chain variable regions that are "the product of" or "derived from" a particular germline sequence. A human antibody that is "the product of" or "derived from" a human germline immunoglobulin sequence can be identified as such by comparing the amino acid sequence of the human antibody to the amino acid sequences of human germline immunoglobulins and selecting the human germline immunoglobulin sequence that is closest in sequence (i.e., greatest % identity) to the sequence of the human antibody (using the methods outlined herein). A human antibody that is "the product of" or "derived from" a particular human germline immunoglobulin sequence may contain amino acid differences as compared to the germline sequence, due to, for example, naturally-occurring somatic mutations or intentional introduction of site-directed mutation. However, a humanized antibody typically is at least 90% identical in amino acids sequence to an amino acid sequence encoded by a human germline immunoglobulin gene and contains amino acid residues that identify the antibody as being derived from human sequences when compared to the germline immunoglobulin amino acid sequences of other species (e.g., murine germline sequences). In certain cases, a humanized antibody may be at least 95, 96, 97, 98 or 99%, or even at least 96%, 97%, 98%, or 99% identical in amino acid sequence to the amino acid sequence encoded by the germline immunoglobulin gene. Typically, a humanized antibody derived from a particular human germline sequence will display no more than 10-20 amino acid differences from the amino acid sequence encoded by the human germline immunoglobulin gene (prior to the introduction of any skew, pI and ablation variants herein; that is, the number of variants is generally low, prior to the introduction of the variants of the invention). In certain cases, the humanized antibody may display no more than 5, or even no more than 4, 3, 2, or 1 amino acid difference from the amino acid sequence encoded by the germline immunoglobulin gene (again, prior to the introduction of any skew, pI and ablation variants herein; that is, the number of variants is generally low, prior to the introduction of the variants of the invention).

In one embodiment, the parent antibody has been affinity matured, as is known in the art. Structure-based methods may be employed for humanization and affinity maturation, for example as described in U.S. Ser. No. 11/004,590. Selection based methods may be employed to humanize and/or affinity mature antibody variable regions, including but not limited to methods described in Wu et al., 1999, J. Mol. Biol. 294:151-162; Baca et al., 1997, J. Biol. Chem. 272(16):10678-10684; Rosok et al., 1996, J. Biol. Chem. 271(37): 22611-22618; Rader et al., 1998, Proc. Natl. Acad. Sci. USA 95: 8910-8915; Krauss et al., 2003, Protein Engineering 16(10):753-759, all entirely incorporated by reference. Other humanization methods may involve the grafting of only parts of the CDRs, including but not limited to methods described in U.S. Ser. No. 09/810,510; Tan et al., 2002, J. Immunol. 169:1119-1125; De Pascalis et al., 2002, J. Immunol. 169:3076-3084, all entirely incorporated by reference.

VII. HETERODIMERIC ANTIBODIES

Accordingly, in some embodiments the present invention provides heterodimeric checkpoint antibodies that rely on the use of two different heavy chain variant Fc sequences, that will self-assemble to form heterodimeric Fc domains and heterodimeric antibodies.

The present invention is directed to novel constructs to provide heterodimeric antibodies that allow binding to more than one checkpoint antigen or ligand, e.g. to allow for bispecific binding. The heterodimeric antibody constructs are based on the self-assembling nature of the two Fc domains of the heavy chains of antibodies, e.g. two "monomers" that assemble into a "dimer". Heterodimeric antibodies are made by altering the amino acid sequence of each monomer as more fully discussed below. Thus, the present invention is generally directed to the creation of heterodimeric checkpoint antibodies which can co-engage antigens in several ways, relying on amino acid variants in the constant regions that are different on each chain to promote heterodimeric formation and/or allow for ease of purification of heterodimers over the homodimers.

Thus, the present invention provides bispecific antibodies. An ongoing problem in antibody technologies is the desire for "bispecific" antibodies that bind to two different antigens simultaneously, in general thus allowing the different antigens to be brought into proximity and resulting in new functionalities and new therapies. In general, these antibodies are made by including genes for each heavy and light chain into the host cells. This generally results in the formation of the desired heterodimer (A-B), as well as the two homodimers (A-A and B-B (not including the light chain heterodimeric issues)). However, a major obstacle in the formation of bispecific antibodies is the difficulty in purifying the heterodimeric antibodies away from the homodimeric antibodies and/or biasing the formation of the heterodimer over the formation of the homodimers.

There are a number of mechanisms that can be used to generate the heterodimers of the present invention. In addition, as will be appreciated by those in the art, these mechanisms can be combined to ensure high heterodimerization. Thus, amino acid variants that lead to the production of heterodimers are referred to as "heterodimerization variants". As discussed below, heterodimerization variants can include steric variants (e.g. the "knobs and holes" or "skew" variants described below and the "charge pairs" variants described below) as well as "pI variants", which allows purification of homodimers away from heterodimers. As is generally described in WO2014/145806, hereby incorporated by reference in its entirety and specifically as below for the discussion of "heterodimerization variants", useful mechanisms for heterodimerization include "knobs and holes" ("KIH"; sometimes herein as "skew" variants (see discussion in WO2014/145806), "electrostatic steering" or "charge pairs" as described in WO2014/145806, pI variants as described in WO2014/145806, and general additional Fc variants as outlined in WO2014/145806 and below.

In the present invention, there are several basic mechanisms that can lead to ease of purifying heterodimeric antibodies; one relies on the use of pI variants, such that each monomer has a different pI, thus allowing the isoelectric purification of A-A, A-B and B-B dimeric proteins. Alternatively, some scaffold formats, such as the "triple F" format, also allows separation on the basis of size. As is further outlined below, it is also possible to "skew" the formation of heterodimers over homodimers. Thus, a combination of steric heterodimerization variants and pI or charge pair variants find particular use in the invention.

In general, embodiments of particular use in the present invention rely on sets of variants that include skew variants, which encourage heterodimerization formation over homodimerization formation, coupled with pI variants, which increase the pI difference between the two monomers to facilitate purification of heterodimers away from homodimers.

Additionally, as more fully outlined below, depending on the format of the heterodimer antibody, pI variants can be either contained within the constant and/or Fc domains of a monomer, or charged linkers, either domain linkers or scFv linkers, can be used. That is, scaffolds that utilize scFv(s) such as the Triple F format can include charged scFv linkers (either positive or negative), that give a further pI boost for purification purposes. As will be appreciated by those in the art, some Triple F formats are useful with just charged scFv linkers and no additional pI adjustments, although the invention does provide pI variants that are on one or both of the monomers, and/or charged domain linkers as well. In addition, additional amino acid engineering for alternative functionalities may also confer pI changes, such as Fc, FcRn and KO variants.

In the present invention that utilizes pI as a separation mechanism to allow the purification of heterodimeric proteins, amino acid variants can be introduced into one or both of the monomer polypeptides; that is, the pI of one of the monomers (referred to herein for simplicity as "monomer A") can be engineered away from monomer B, or both monomer A and B change be changed, with the pI of monomer A increasing and the pI of monomer B decreasing. As discussed, the pI changes of either or both monomers can be done by removing or adding a charged residue (e.g. a neutral amino acid is replaced by a positively or negatively charged amino acid residue, e.g. glycine to glutamic acid), changing a charged residue from positive or negative to the opposite charge (e.g. aspartic acid to lysine) or changing a charged residue to a neutral residue (e.g. loss of a charge; lysine to serine.). A number of these variants are shown in the Figures.

Accordingly, this embodiment of the present invention provides for creating a sufficient change in pI in at least one of the monomers such that heterodimers can be separated from homodimers. As will be appreciated by those in the art, and as discussed further below, this can be done by using a "wild type" heavy chain constant region and a variant region that has been engineered to either increase or decrease its pI (wt A−+B or wt A−−B), or by increasing one region and decreasing the other region (A+−B—or A−B+).

Thus, in general, a component of some embodiments of the present invention are amino acid variants in the constant regions of antibodies that are directed to altering the isoelectric point (pI) of at least one, if not both, of the monomers of a dimeric protein to form "pI antibodies" by incorporating amino acid substitutions ("pI variants" or "pI substitutions") into one or both of the monomers. As shown herein, the separation of the heterodimers from the two homodimers can be accomplished if the pIs of the two monomers differ by as little as 0.1 pH unit, with 0.2, 0.3, 0.4 and 0.5 or greater all finding use in the present invention.

As will be appreciated by those in the art, the number of pI variants to be included on each or both monomer(s) to get good separation will depend in part on the starting pI of the components, for example in the triple F format, the starting pI of the scFv and Fab of interest. That is, to determine which monomer to engineer or in which "direction" (e.g. more positive or more negative), the Fv sequences of the two target antigens are calculated and a decision is made from there. As is known in the art, different Fvs will have different starting pIs which are exploited in the present invention. In general, as outlined herein, the pIs are engineered to result in a total pI difference of each monomer of at least about 0.1 logs, with 0.2 to 0.5 being preferred as outlined herein.

Furthermore, as will be appreciated by those in the art and outlined herein, in some embodiments, heterodimers can be separated from homodimers on the basis of size.

Figure 1A:
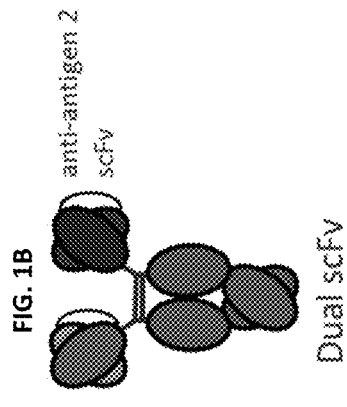
Figure 1B:
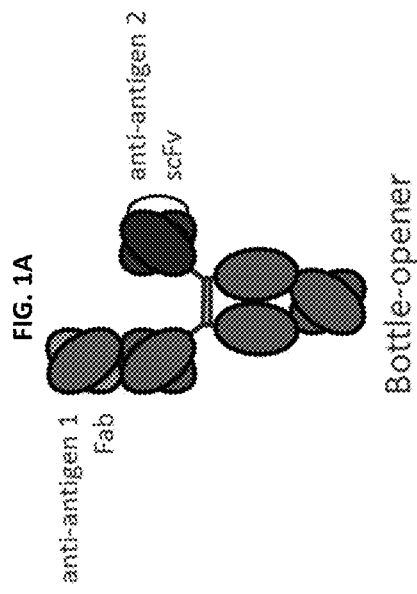
Figure 1C:
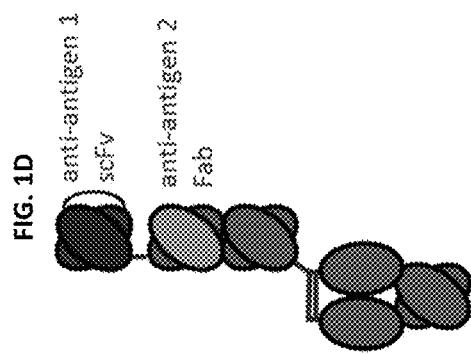
Figure 1D:
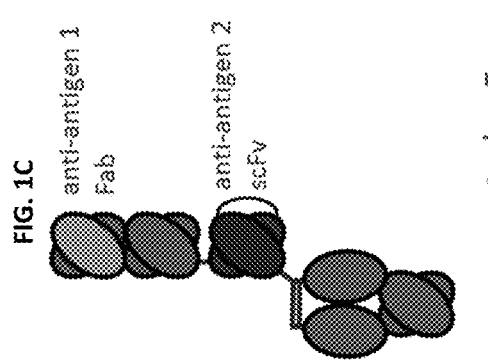
Figure 1N:
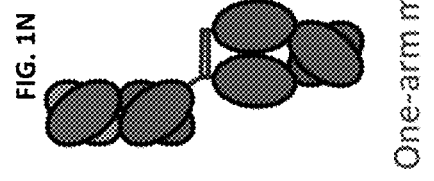
Figure 1M:
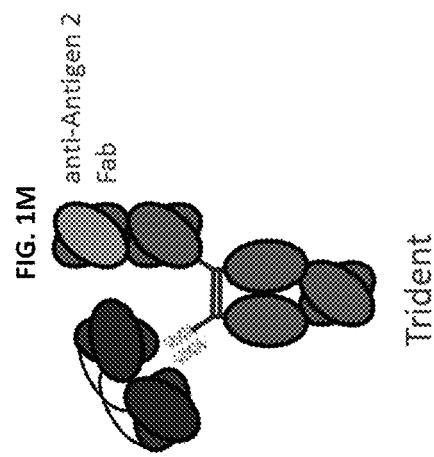
Figure 1O:
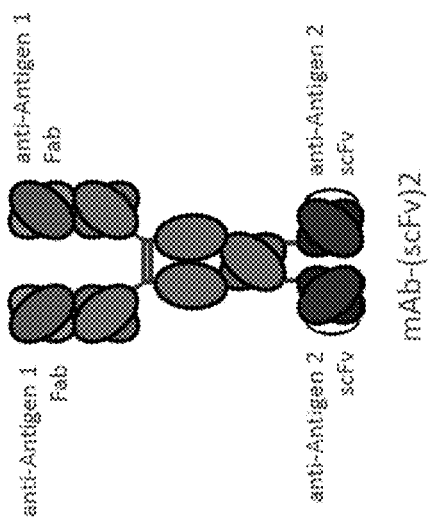

As shown in FIG. 1A-1O for example, several of the formats allow separation of heterodimers and homodimers on the basis of size.

A. Heterodimerization Variants

The present invention provides heterodimeric proteins, including heterodimeric antibodies in a variety of formats, which utilize heterodimeric variants to allow for heterodimeric formation and/or purification away from homodimers.

There are a number of suitable pairs of sets of heterodimerization skew variants. These variants come in "pairs" of "sets". That is, one set of the pair is incorporated into the first monomer and the other set of the pair is incorporated into the second monomer. It should be noted that these sets do not necessarily behave as "knobs in holes" variants, with a one-to-one correspondence between a residue on one monomer and a residue on the other; that is, these pairs of sets form an interface between the two monomers that encourages heterodimer formation and discourages homodimer formation, allowing the percentage of heterodimers that spontaneously form under biological conditions to be over 90%, rather than the expected 50% (25% homodimer A/A: 50% heterodimer A/B:25% homodimer B/B).

B. Steric Variants

In some embodiments, the formation of heterodimers can be facilitated by the addition of steric variants. That is, by changing amino acids in each heavy chain, different heavy chains are more likely to associate to form the heterodimeric structure than to form homodimers with the same Fc amino acid sequences. Suitable steric variants are included in in the Figures.

One mechanism is generally referred to in the art as "knobs and holes", referring to amino acid engineering that creates steric influences to favor heterodimeric formation and disfavor homodimeric formation can also optionally be used; this is sometimes referred to as "knobs and holes", as described in U.S. Ser. No. 61/596,846, Ridgway et al., Protein Engineering 9(7):617 (1996); Atwell et al., J. Mol. Biol. 1997 270:26; U.S. Pat. No. 8,216,805, all of which are hereby incorporated by reference in their entirety. The Figures identify a number of "monomer A-monomer B" pairs that rely on "knobs and holes". In addition, as described in Merchant et al., Nature Biotech. 16:677 (1998), these "knobs and hole" mutations can be combined with disulfide bonds to skew formation to heterodimerization.

An additional mechanism that finds use in the generation of heterodimers is sometimes referred to as "electrostatic steering" as described in Gunasekaran et al., J. Biol. Chem. 285(25):19637 (2010), hereby incorporated by reference in its entirety. This is sometimes referred to herein as "charge pairs". In this embodiment, electrostatics are used to skew the formation towards heterodimerization. As those in the art will appreciate, these may also have have an effect on pI, and thus on purification, and thus could in some cases also be considered pI variants. However, as these were generated to force heterodimerization and were not used as purification tools, they are classified as "steric variants". These include, but are not limited to, D221E/P228E/L368E paired with D221R/P228R/K409R (e.g. these are "monomer corresponding sets) and C220E/P228E/368E paired with C220R/E224R/P228R/K409R.

Additional monomer A and monomer B variants that can be combined with other variants, optionally and independently in any amount, such as pI variants outlined herein or other steric variants that are shown in FIG. 37 of US 2012/0149876, the figure and legend and SEQ ID NOs of which are incorporated expressly by reference herein.

In some embodiments, the steric variants outlined herein can be optionally and independently incorporated with any pI variant (or other variants such as Fc variants, FcRn variants, etc.) into one or both monomers, and can be independently and optionally included or excluded from the proteins of the invention.

A list of suitable skew variants is found in FIGS. 3A-3F and FIG. 8 showing some pairs of particular utility in many embodiments. Of particular use in many embodiments are the pairs of sets including, but not limited to, S364K/E357Q: L368D/K370S; L368D/K370S: S364K; L368E/K370S: S364K; T411T/E360E/Q362E: D401K; L368D/K370S: S364K/E357L, K370S: S364K/E357Q and T366S/L368A/Y407V: T366W (optionally including a bridging disulfide, T366S/L368A/Y407V/Y349C: T366W/S354C). In terms of nomenclature, the pair "S364K/E357Q: L368D/K370S" means that one of the monomers has the double variant set S364K/E357Q and the other has the double variant set L368D/K370S; as above, the "strandedness" of these pairs depends on the starting pI.

C. pI (Isoelectric Point) Variants for Heterodimers

In general, as will be appreciated by those in the art, there are two general categories of pI variants: those that increase the pI of the protein (basic changes) and those that decrease the pI of the protein (acidic changes). As described herein, all combinations of these variants can be done: one monomer may be wild type, or a variant that does not display a significantly different pI from wild-type, and the other can be either more basic or more acidic. Alternatively, each monomer is changed, one to more basic and one to more acidic.

Preferred combinations of pI variants are shown in FIG. 4. As outlined herein and shown in the figures, these changes are shown relative to IgG1, but all isotypes can be altered this way, as well as isotype hybrids. In the case where the heavy chain constant domain is from IgG2-4, R133E and R133Q can also be used.

In one embodiment, for example in the FIGS. 1A, E, F, G, H and I formats, a preferred combination of pI variants has one monomer (the negative Fab side) comprising 208D/295E/384D/418E/421D variants (N208D/Q295E/N384D/Q418E/N421D when relative to human IgG1) and a second monomer (the positive scFv side) comprising a positively charged scFv linker, including (GKPGS)4 (SEQ ID NO: 37755). However, as will be appreciated by those in the art, the first monomer includes a CH1 domain, including position 208. Accordingly, in constructs that do not include a CH1 domain (for example for antibodies that do not utilize a CH1 domain on one of the domains, for example in a dual scFv format or a "one armed" format such as those depicted in FIG. 1B, C or D), a preferred negative pI variant Fc set includes 295E/384D/418E/421D variants (Q295E/N384D/Q418E/N421D when relative to human IgG1).

Accordingly, in some embodiments, one monomer has a set of substitutions from FIG. 4 and the other monomer has a charged linker (either in the form of a charged scFv linker because that monomer comprises an scFv or a charged domain linker, as the format dictates, which can be selected from those depicted in FIGS. 7A-7B).

1. Isotypic Variants

In addition, many embodiments of the invention rely on the "importation" of pI amino acids at particular positions from one IgG isotype into another, thus reducing or eliminating the possibility of unwanted immunogenicity being introduced into the variants. A number of these are shown in FIG. 21 of US Publ. 2014/0370013, hereby incorporated by reference. That is, IgG1 is a common isotype for therapeutic antibodies for a variety of reasons, including high effector function. However, the heavy constant region of IgG1 has a higher pI than that of IgG2 (8.10 versus 7.31). By introducing IgG2 residues at particular positions into the IgG1 backbone, the pI of the resulting monomer is lowered (or increased) and additionally exhibits longer serum half-life. For example, IgG1 has a glycine (pI 5.97) at position 137, and IgG2 has a glutamic acid (pI 3.22); importing the glutamic acid will affect the pI of the resulting protein. As is described below, a number of amino acid substitutions are generally required to significant affect the pI of the variant antibody. However, it should be noted as discussed below that even changes in IgG2 molecules allow for increased serum half-life.

In other embodiments, non-isotypic amino acid changes are made, either to reduce the overall charge state of the resulting protein (e.g. by changing a higher pI amino acid to a lower pI amino acid), or to allow accommodations in structure for stability, etc. as is more further described below.

In addition, by pI engineering both the heavy and light constant domains, significant changes in each monomer of the heterodimer can be seen. As discussed herein, having the pIs of the two monomers differ by at least 0.5 can allow separation by ion exchange chromatography or isoelectric focusing, or other methods sensitive to isoelectric point.

D. Calculating pI

The pI of each monomer can depend on the pI of the variant heavy chain constant domain and the pI of the total monomer, including the variant heavy chain constant domain and the fusion partner. Thus, in some embodiments, the change in pI is calculated on the basis of the variant heavy chain constant domain, using the chart in the FIG. 19 of US Pub. 2014/0370013. As discussed herein, which monomer to engineer is generally decided by the inherent pI of the Fv and scaffold regions. Alternatively, the pI of each monomer can be compared.

E. pI Variants that Also Confer Better FcRn In Vivo Binding

In the case where the pI variant decreases the pI of the monomer, they can have the added benefit of improving serum retention in vivo.

Although still under examination, Fc regions are believed to have longer half-lives in vivo, because binding to FcRn at pH 6 in an endosome sequesters the Fc (Ghetie and Ward, 1997 Immunol Today. 18(12): 592-598, entirely incorporated by reference). The endosomal compartment then recycles the Fc to the cell surface. Once the compartment opens to the extracellular space, the higher pH, ~7.4, induces the release of Fc back into the blood. In mice, Dall'Acqua et al. showed that Fc mutants with increased FcRn binding at pH 6 and pH 7.4 actually had reduced serum concentrations and the same half life as wild-type Fc (Dall'Acqua et al. 2002, J. Immunol. 169:5171-5180, entirely incorporated by reference). The increased affinity of Fc for FcRn at pH 7.4 is thought to forbid the release of the Fc back into the blood. Therefore, the Fc mutations that will increase Fc's half-life in vivo will ideally increase FcRn binding at the lower pH while still allowing release of Fc at higher pH. The amino acid histidine changes its charge state in the pH range of 6.0 to 7.4. Therefore, it is not surprising to find His residues at important positions in the Fc/FcRn complex.

Recently it has been suggested that antibodies with variable regions that have lower isoelectric points may also have longer serum half-lives (Igawa et al., 2010 PEDS. 23(5): 385-392, entirely incorporated by reference). However, the mechanism of this is still poorly understood. Moreover, variable regions differ from antibody to antibody. Constant region variants with reduced pI and extended half-life would provide a more modular approach to improving the pharmacokinetic properties of antibodies, as described herein.

F. Additional Fc Variants for Additional Functionality

In addition to pI amino acid variants, there are a number of useful Fc amino acid modification that can be made for a variety of reasons, including, but not limited to, altering binding to one or more FcγR receptors, altered binding to FcRn receptors, etc.

Accordingly, the proteins of the invention can include amino acid modifications, including the heterodimerization variants outlined herein, which includes the pI variants and steric variants. Each set of variants can be independently and optionally included or excluded from any particular heterodimeric protein.

G. FcγR Variants

Accordingly, there are a number of useful Fc substitutions that can be made to alter binding to one or more of the FcγR receptors. Substitutions that result in increased binding as well as decreased binding can be useful. For example, it is known that increased binding to FcγRIIIa results in increased ADCC (antibody dependent cell-mediated cytotoxicity; the cell-mediated reaction wherein nonspecific cytotoxic cells that express FcγRs recognize bound antibody on a target cell and subsequently cause lysis of the target cell). Similarly, decreased binding to FcγRIIb (an inhibitory receptor) can be beneficial as well in some circumstances. Amino acid substitutions that find use in the present invention include those listed in U.S. Ser. No. 11/124,620 (particularly FIG. 41), Ser. Nos. 11/174,287, 11/396,495, 11/538,406, all of which are expressly incorporated herein by reference in their entirety and specifically for the variants disclosed therein. Particular variants that find use include, but are not limited to, 236A, 239D, 239E, 332E, 332D, 239D/332E, 267D, 267E, 328F, 267E/328F, 236A/332E, 239D/332E/330Y, 239D, 332E/330L, 243A, 243L, 264A, 264V and 299T.

In addition, there are additional Fc substitutions that find use in increased binding to the FcRn receptor and increased serum half life, as specifically disclosed in U.S. Ser. No. 12/341,769, hereby incorporated by reference in its entirety, including, but not limited to, 434S, 434A, 428L, 308F, 259I, 428L/434S, 259I/308F, 436I/428L, 436I or V/434S, 436V/428L and 259I/308F/428L.

H. Ablation Variants

Similarly, another category of functional variants are "FcγR ablation variants" or "Fc knock out (FcKO or KO)" variants. In these embodiments, for some therapeutic applications, it is desirable to reduce or remove the normal binding of the Fc domain to one or more or all of the Fcγ receptors (e.g. FcγR1, FcγRIIa, FcγRIIb, FcγRIIIa, etc.) to avoid additional mechanisms of action. That is, for example, in many embodiments, particularly in the use of bispecific checkpoint antibodies desirable to ablate FcγRIIIa binding to eliminate or significantly reduce ADCC activity such that one of the Fc domains comprises one or more Fcγ receptor ablation variants. These ablation variants are depicted in FIG. 5, and each can be independently and optionally included or excluded, with preferred aspects utilizing ablation variants selected from the group consisting of G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G and E233P/L234V/L235A/G236del. It should be noted that the ablation variants referenced herein ablate FcγR binding but generally not FcRn binding.

As is known in the art, the Fc domain of human IgG1 has the highest binding to the Fcγ receptors, and thus ablation variants can be used when the constant domain (or Fc domain) in the backbone of the heterodimeric antibody is IgG1. Alternatively, or in addition to ablation variants in an IgG1 background, mutations at the glycosylation position 297 (generally to A or S) can significantly ablate binding to FcγRIIIa, for example. Human IgG2 and IgG4 have naturally reduced binding to the Fcγ receptors, and thus those backbones can be used with or without the ablation variants.

I. Combination of Heterodimeric and Fc Variants

As will be appreciated by those in the art, all of the recited heterodimerization variants (including skew and/or pI variants) can be optionally and independently combined in any way, as long as they retain their "strandedness" or "monomer partition". In addition, all of these variants can be combined into any of the heterodimerization formats.

In the case of pI variants, while embodiments finding particular use are shown in the Figures, other combinations can be generated, following the basic rule of altering the pI difference between two monomers to facilitate purification.

In addition, any of the heterodimerization variants, skew and pI, are also independently and optionally combined with Fc ablation variants, Fc variants, FcRn variants, as generally outlined herein. Preferred combinations are shown in FIGS. 6A-6B.

Antigen Binding Domains to Target Antigens

The bispecific antibodies of the invention have two different antigen binding domains (ABDs) that bind to two different target antigens ("target pairs"), in either bivalent, bispecific formats or trivalent, bispecific formats as generally shown in FIG. 1A-1O. In the present invention, the bispecific heterodimeric antibodies target human PD-1 on one side and a second antigen on the other side selected from CTLA-4, TIM-3, LAG-3, TIGIT, ICOS and BTLA, the sequences of which are shown in FIG. 2. Accordingly, suitable bispecific antibodies bind PD-1 and CTLA-4, PD-1 and TIM-3, PD-1 and LAG-3, PD-1 and TIGIT, PD-1 and BTLA and PD-1 and ICOS. Note that generally these bispecific antibodies are named "anti-PD-1 X anti-CTLA-4", or generally simplistically or for ease (and thus interchangeably) as "PD-1 X CTLA-4", etc. for each pair. Note that unless specified herein, the order of the antigen list in the name does not confer structure; that is a PD-1 X CTLA-4 bottle opener antibody can have the scFv bind to PD-1 or CTLA-4, although in some cases, the order specifies structure as indicated.

As is more fully outlined herein, these combinations of ABDs can be in a variety of formats, as outlined below, generally in combinations where one ABD is in a Fab format and the other is in an scFv format. As discussed herein and shown in FIG. 1A-1O, some formats use a single Fab and a single scFv (FIGS. 1A, C and D), and some formats use two Fabs and a single scFv (FIGS. 1E, F, G, H and I).

VIII. ANTIGEN BINDING DOMAINS

As discussed herein, the bispecific heterodimeric antibodies of the invention include two antigen binding domains (ABDs), each of which bind to a different target protein. As outlined herein, these heterodimeric antibodies can be bispecific and bivalent (each antigen is bound by a single ABD, for example, in the format depicted in FIG. 1A), or bispecific and trivalent (one antigen is bound by a single ABD and the other is bound by two ABDs, for example as depicted in FIG. 1F).

In addition, in general, one of the ABDs comprises a scFv as outlined herein, in an orientation from N- to C-terminus of vh-scFv linker-vl or vl-scFv linker-vh. One or both of the other ABDs, according to the format, generally is a Fab, comprising a vh domain on one protein chain (generally as a component of a heavy chain) and a vl on another protein chain (generally as a component of a light chain).

The invention provides a number of ABDs that bind to a number of different target proteins, as outlined below. As will be appreciated by those in the art, any set of 6 CDRs or vh and vl domains can be in the scFv format or in the Fab format, which is then added to the heavy and light constant domains, where the heavy constant domains comprise variants (including within the CH1 domain as well as the Fc domain). The scFv sequences contained in the sequence listing utilize a particular charged linker, but as outlined herein, uncharged or other charged linkers can be used, including those depicted in FIGS. 7A-7B.

In addition, as discussed above, the numbering used in the Sequence Listing for the identification of the CDRs is Kabat, however, different numbering can be used, which will change the amino acid sequences of the CDRs as shown in Table 1.

For all of the variable heavy and light domains listed herein, further variants can be made. As outlined herein, in some embodiments the set of 6 CDRs can have from 0, 1, 2, 3, 4 or 5 amino acid modifications (with amino acid substitutions finding particular use), as well as changes in the framework regions of the variable heavy and light domains, as long as the frameworks (excluding the CDRs) retain at least about 80, 85 or 90% identity to a human germline sequence selected from those listed in FIG. 1 of U.S. Pat. No. 7,657,380, which Figure and Legend is incorporated by reference in its entirety herein. Thus, for example, the identical CDRs as described herein can be combined with different framework sequences from human germline sequences, as long as the framework regions retain at least 80, 85 or 90% identity to a human germline sequence selected from those listed in FIG. 1 of U.S. Pat. No. 7,657,380. Alternatively, the CDRs can have amino acid modifications (e.g. from 1, 2, 3, 4 or 5 amino acid modifications in the set of CDRs (that is, the CDRs can be modified as long as the total number of changes in the set of 6 CDRs is less than 6 amino acid modifications, with any combination of CDRs being changed; e.g. there may be one change in vlCDR1, two in vhCDR2, none in vhCDR3, etc.)), as well as having framework region changes, as long as the framework regions retain at least 80, 85 or 90% identity to a human germline sequence selected from those listed in FIG. 1 of U.S. Pat. No. 7,657,380.

A. PD-1 Antigen Binding Domains

In the embodiments of the invention, one of the ABDs binds human PD-1. WO 2017/218707, hereby expressly incorporated by reference in its entirety, and specifically for Figures, Legends and SEQ identifiers that depict anti-PD-1 sequences, outlines a large number of anti-PD-1 ABDs, that can be used in combination with ABDs to other checkpoint inhibitors. However, the present disclosure is directed to additional anti-PD-1 ABDs based on the 1C11 done, shown in FIGS. 13, 15, 16, 18, 20, 21, 24, 33 and 40.

As is known in the art, stability of variable domains can change based on the format. That is, VH and VL domains that are identified and/or useful in a Fab format may not be as stable in an scFv format, and thus sometimes additional engineering occurs to increase stability (e.g. Tm).

In useful embodiments, the invention provides anti-PD-1 ABDs comprising a VHCDR1 comprising the amino acid sequence HYG(M/I)N; a VHCDR2 comprising the amino acid sequence WINT(Y/H)TGEP(T/Y)YA(D/P)GF(T/Q)(G/E); a VHCDR3 comprising the amino acid sequence DY(F/Y)GSSPY; a VLCDR1 comprising the amino acid sequence VLCDR1 R(S/A)SQSIV(F/H)SNGNTYLE; a VLCDR2 comprising the amino acid sequence KVSNRF(S/T); and a VHCDR3 comprising the amino acid sequence FQGSHVPN. As is known, amino acids depicted as "(S/T)" means that either amino acid can be at this position.

In useful embodiments, the bispecific antibodies of the invention include an ABD to human PD-1. In these embodiments, the six CDRs that confer binding to PD-1 are selected from those depicted in any of FIGS. 13,15, 16,18, 20, 21, 24, 33 and 40. Alternatively in these embodiments, the VH and VL domains that confer binding to PD-1 are selected from those depicted in any of FIGS. 13, 15, 16,18, 20, 21, 24, 33 and 40.

In some embodiments, the bispecific antibodies of the invention include an ABD to PD-1 in a Fab format. In some embodiments, the ABD to PD-1 contains the 6 CDRs of any ABDs of FIGS. 13,16, 18, 20, 21, 24, 33 and 40, or the VH and VL domains from any ABD of FIGS. 13,16, 18, 20, 21, 24, 33 and 40.

Of particular use in many embodiments that have a Fab ABD to PD-1 is the ABD of XENP26940 1C11[PD-1]_H3.303_L3.152 of FIGS. 24A-24J. Thus, the six CDRs and/or the VH and VL domains from XENP026940 can be used in the constructs of the invention.

Of particular use in many embodiments that have a Fab ABD to PD-1 is the ABD of XENP28652 1C11[PD-1]_H3.328_L3.153 of FIG. 40. Thus, the six CDRs and/or the VH and VL domains from XENP28652 can be used in the constructs of the invention.

In some embodiments, the bispecific antibodies of the invention include an ABD to PD-1 in a scFv format. In some embodiments, the ABD to PD-1 contains the 6 CDRs of any ABDs of FIG. 15A-15T, or the VH and VL domains from any ABD of FIG. 15A-15T.

Of particular use in many embodiments that have a scFv ABD to PD-1 is the ABD of XENP025806 1C11[PD-1]_H3.234_L3.144 as depicted in FIG. 15A-15T. Thus, the six CDRs and/or the VH and VL domains from XENP025806 can be used in the constructs of the invention.

Of particular use in many embodiments that have a scFv ABD to PD-1 is the ABD of XENP025812 1C11[PD-1]_H3.240_L3.148 as depicted in FIG. 15A-15T. Thus, the six CDRs and/or the VH and VL domains from XENP025812 can be used in the constructs of the invention.

Of particular use in many embodiments that have a scFv ABD to PD-1 is the ABD of XENP025813 1C11[PD-1]_H3.241_L3.148 as depicted in FIG. 15A-15T. Thus, the six CDRs and/or the VH and VL domains from XENP025813 can be used in the constructs of the invention.

Of particular use in many embodiments that have a scFv ABD to PD-1 is the ABD of XENP025819 1C11[PD-1]_H3.241_L3.92 as depicted in FIG. 15A-15T. Thus, the six CDRs and/or the VH and VL domains from XENP025819 can be used in the constructs of the invention.

B. CTLA-4 Antigen Binding Domains

As will be appreciated by those in the art, any number of anti-CTLA-4 ABD sequences can be used in combination with the scFv anti-PD-1 sequences of the invention in the creation of bispecific antibodies. Anti-CTLA-4 sequences suitable for use as ABDs include SEQ ID NOs: 21-2918 (CTLA-4 scFv sequences, although the Fv sequences therein can be formatted as Fabs), SEQ ID NOs: 2919-6208 (CTLA-4 Fab sequences, although the Fv sequences therein can be formatted as scFvs), SEQ ID NOs: 36739-36818 (additional CTLA-4 Fab sequences, although the Fv sequences therein can be formatted as scFvs) and SEQ ID NOs: 35395-35416 (CTLA-4 one armed constructs, which can be formatted as either Fabs or scFvs). As will be understood from those in the art, these sequence identifiers come in "pairs" for the variable heavy and light chains, as will be apparent from the sequence identifiers.

In some embodiments, an anti-CTLA-4 Fab is selected from the pairs of SEQ ID NOs:36739 and 36743, 36747 and 36751, 36755 and 36759, 36763 and 36767, 36771 and 36775, 36779 and 36783, 36787 and 36791, 36795 and 36799, 36803 and 36807 and 36811 and 36815 of the sequence listing.

Of particular interest in the present invention are the sequences of the Fab CTLA-4 ABD of CTLA-4 H3_L0.22, including the VH (SEQ ID NO:38134, with VHCDRs (SEQ ID NOs:38135, 38136 and 38137) and VL (SEQ ID NO:38138 with VLCDRs (SEQ ID NOs:38139, 38140 and 38141).

C. LAG-3 Antigen Binding Domains

As will be appreciated by those in the art, any number of anti-LAG-3 ABD sequences can be used in combination with the scFv anti-PD-1 sequences of the invention in the creation of bispecific antibodies. Anti-LAG-3 sequences suitable for use as ABDs include SEQ ID NOs: 17135-20764 (LAG-3 Fabs, although the Fv sequences therein can be formatted as scFvs), SEQ ID NOs: 36819-36962 (additional LAG-3 Fabs although the Fv sequences therein can be formatted as scFvs), SEQ ID NOs: 35417-35606 (additional LAG-3 Fabs although the Fv sequences therein can be formatted as scFvs), SEQ ID NOs: 25194-32793 (additional LAG-3 Fabs although the Fv sequences therein can be formatted as scFvs) and SEQ ID NOs: 32794-33002 (one armed LAG-3 constructs which can be formatted as either Fabs or scFvs). As will be understood from those in the art, these sequence identifiers come in "pairs" for the variable heavy and light chains, as will be apparent from the sequence identifiers.

In some embodiments, an anti-LAG-3 Fab is selected from the pairs of SEQ ID NOs:36819 and 36823, 36827 and 36831, 36835 and 36839, 36843 and 36847, 36851 and 36855, 36859 and 36863, 36867 and 36871, 36875 and 36879, 36883 and 36887, 36891 and 36895, 36899 and 36903, 36907 and 36911, 36915 and 36919, 36923 and 36927, 36931 and 36935, 36939 and 36943, 36947 and 36951 and 36955 and 36959.

Of particular interest in the present invention are the sequences of the LAG-3 Fab ABD of XENP22594, including the VH (SEQ ID NO:32755, with VHCDRs (SEQ ID NOs:32756, 32757 and 32758) and VL (SEQ ID NO:32760 with VLCDRs (SEQ ID NOs:32761, 32762 and 32763).

Of particular interest in the present invention are the sequences of the LAG-3 Fab ABD of XENP22656, including the VH (SEQ ID NO:28815, with VHCDRs (SEQ ID NOs:28816, 28817, and 28118) and VL (SEQ ID NO:28820, with VLCDRs (SEQ ID NOs:28821, 28822 and 28823).

D. TIM-3 Antigen Binding Domains

As will be appreciated by those in the art, any number of anti-TIM-3 ABD sequences can be used in combination with the scFv anti-PD-1 sequences of the invention in the creation of bispecific antibodies. Anti-TIM-3 sequences suitable for use as ABDs include SEQ ID NOs: 20765-20884 (TIM-3

Fabs, although the Fv sequences therein can be formatted as scFvs), SEQ ID NOs: 37587-37698 (additional TIM-3 Fabs, the Fv sequences therein can be formatted as scFvs) and SEQ ID NOs: 36347-36706 (bivalent TIM-3 constructs which can be formatted as either Fabs or scFvs). As will be understood from those in the art, these sequence identifiers come in "pairs" for the variable heavy and light chains, as will be apparent from the sequence identifiers.

In some embodiments, the anti-TIM-3 ABD is selected from the pairs of SEQ ID NOs:35757 and 37591, 37959 and 37599, 37603 and 37607, 37611 and 37615, 37619 and 37623, 37627 and 37631, 37635 and 37639, 37643 and 37647, 37651 and 37655, 37659 and 37663, 37667 and 37671, 37675 and 37679, 37683 and 37687 and 37691 and 37695.

Of particular interest in the present invention are the Fab sequences of the anti-TIM-3 ABD of XENP21189, including the VH (SEQ ID NO:36508, with VHCDRs (SEQ ID NOs:36509, 36510 and 36511) and VL (SEQ ID NO:36513, with VLCDRs (SEQ ID NOs:36514, 36515 and 36516).

E. BTLA Antigen Binding Domains

As will be appreciated by those in the art, any number of anti-BTLA ABD sequences can be used in combination with the scFv anti-PD-1 sequences of the invention in the creation of bispecific antibodies. Anti-BTLA sequences suitable for use as ABDs include SEQ ID NOs: 20885-21503 (BTLA Fabs although the Fv sequences therein can be formatted as scFvs) and SEQ ID NOs: 36707-36738 (additional BTLA Fabs although the Fv sequences therein can be formatted as scFvs). As will be understood from those in the art, these sequence identifiers come in "pairs" for the variable heavy and light chains, as will be apparent from the sequence identifiers.

In some embodiments, the anti-BTLA ABD of use in the invention are selected from the pairs of SEQ ID NOs:36707 and 36711, 36715 and 36719, 36723 and 36727 and 36761 and 36735.

Of particular interest in the present invention are the Fab sequences of the anti-BTLA ABD of XENP20269, including the VH (SEQ ID NO:20936, with VHCDRs (SEQ ID NOs:20937, 20938 and 20939) and VL (SEQ ID NO:20941, with VLCDRs (SEQ ID NOs:20942, 20943 and 20944).

F ICOS Antigen Binding Domains

As will be appreciated by those in the art, any number of anti-ICOS ABD sequences can be used in combination with the scFv anti-PD-1 sequences of the invention in the creation of bispecific antibodies. Anti-ICOS sequences suitable for use as ABDs include many as disclosed in US2018/0127501, expressly incorporated by reference in its entirety and specifically for the legends and FIGS. 19, 20 and 24, the sequences depicted therein, as well as SEQ ID NOs:27869-28086 from US2018/0127501 which contain a number of ICOS Fab sequences (heavy chain VH1-CH1 and light chain VL1-CL) as indicated in the naming nomenclature. As will be understood from those in the art, these sequence identifiers come in "pairs" for the variable heavy and light chains, as will be apparent from the sequence identifiers.

In some embodiments, the anti-ICOS ABD of use in the invention are selected from the pairs of SEQ ID NOs:26323 and 26328, 27477 and 27452 and 26353 and 26358 from the sequence listing from US2018/0127501.

Of particular interest in the present invention are the Fab sequences of the anti-ICOS ABD from XENCS500 in FIGS. 49A-49KK, with $V_H$_ICOS_H0_L0 and VL_ICOS_H0_L0.

Of particular interest in the present invention are the Fab sequences of the anti-ICOS ABD from XENCS501 in FIGS. 49A-49KK, with VH_ICOS_H0.66_L0 and VL_ICOS_H0.66_L0.

G. TIGIT Antigen Binding Domains

Anti-TIGIT sequences suitable for use as ABDs include SEQ ID NOs: 21504-21523 and SEQ ID NOs: 37435-37586 (as will be understood from those in the art, these sequence identifiers come in "pairs" for the variable heavy and light chains, as will be apparent from the sequence identifiers), as well as TIGIT ABDs selected from the pairs of SEQ ID NOs:37435 and 37439, 37443 and 37447, 37451 and 37455, 37459 and 37463, 37467 and 37471, 37475 and 37479, 37483 and 37487, 37491 and 37495, 37499 and 37503, 37507 and 37511, 37515 and 37519, 37523 and 37527, 37531 and 37535, 37539 and 37543, 37547 and 37551, 37555 and 37559, 37563 and 37567, 37571 and 37575 and 37579 and 37583.

IX. MONOVALENT ANTI-PD-1 ANTIBODIES

In addition, as will be appreciated by those in the art, the novel Fv sequences outlined herein can also be used in both monospecific antibodies (e.g. "traditional monoclonal antibodies") or non-heterodimeric bispecific formats. Accordingly, the present invention provides monoclonal (monospecific) antibodies comprising the 6 CDRs and/or the vh and vl sequences from the figures, generally with IgG1, IgG2, IgG3 or IgG4 constant regions, with IgG1, IgG2 and IgG4 (including IgG4 constant regions comprising a S228P amino acid substitution) finding particular use in some embodiments. That is, any sequence herein with a "H_L" designation can be linked to the constant region of a human IgG1 antibody.

A. Anti-PD-1 Monoclonal Antibodies

As will be appreciated by those in the art, the novel Fv sequences outlined herein can also be used in both mono-specific antibodies (e.g. "traditional monoclonal antibodies") or non-heterodimeric bispecific formats. Accordingly, the present invention provides monoclonal (monospecific) antibodies comprising the 6 CDRs and/or the vh and vl sequences from the figures, generally with IgG1, IgG2, IgG3 or IgG4 constant regions, with IgG1, IgG2 and IgG4 (including IgG4 constant regions comprising a S228P amino acid substitution) finding particular use in some embodiments. That is, any sequence herein with a "H_L" designation can be linked to the constant region of a human IgG1 antibody.

In some embodiments, the monoclonal antibody is selected from those depicted in FIGS. 13, 16,18, 20, 21, 24, 33 and 40.

In some embodiments, antibodies comprising a VH and VL domain from XENP26940 1C11[PD-1]_H3.303_L3.152 of FIGS. 24A-24J. Thus, the six CDRs and/or the VH and VL domains from XENP026940 can be used in the creation of monoclonal antibodies. In some embodiments, the VH and VL from XENP026940 can be used with a IgG1 constant domain. In some embodiments, the VH and VL from XENP026940 can be used with a IgG1 constant domain, that may contain additional Fc variants, in particular the 428L/434S FcRn variants. In some embodiments, the VH and VL from XENP026940 can be used with a IgG4 constant domain, particularly with a S228P amino acid substitution. In some embodiments, the antibody is XENP26940.

In some embodiments, antibodies comprising a VH and VL domain from XENP28652 1C11[PD-1]_H3.328_L3.153 of FIG. 40. Thus, the six CDRs and/or the VH and VL domains from XENP28652 can be used in the creation of monoclonal antibodies. In some embodiments, the VH and VL from XENP28652 can be used with a IgG1 constant domain. In some embodiments, the VH and VL from XENP28652 can be used with a IgG1 constant domain, that may contain additional Fc variants, in particular the 428L/434S FcRn variants. In some embodiments, the VH and VL from XENP28652 can be used with a IgG4 constant domain, particularly with a S228P amino acid substitution. In some embodiments, the antibody is XENP28652.

X. USEFUL FORMATS OF THE INVENTION

As will be appreciated by those in the art and discussed more fully below, the bispecific heterodimeric antibodies of the present invention can take on a wide variety of configurations, as are generally depicted in FIG. 1. Some figures depict "single ended" configurations, where there is one type of specificity on one "arm" of the molecule and a different specificity on the other "arm". Other figures depict "dual ended" configurations, where there is at least one type of specificity at the "top" of the molecule and one or more different specificities at the "bottom" of the molecule. Thus, the present invention is directed to novel immunoglobulin compositions that co-engage a different first and a second antigen.

As will be appreciated by those in the art, the heterodimeric formats of the invention can have different valencies as well as be bispecific. That is, heterodimeric antibodies of the invention can be bivalent and bispecific, wherein one checkpoint target is bound by one ABD and the other checkpoint target is bound by a second ABD. The heterodimeric antibodies can also be trivalent and bispecific, wherein the first antigen is bound by two ABDs and the second antigen by a second ABD.

A. Bottle Opener Format

One heterodimeric scaffold that finds particular use in the present invention is the "triple F" or "bottle opener" scaffold format as shown in FIG. 1. In this embodiment, one heavy chain of the antibody contains a single chain Fv ("scFv", as defined herein) and the other heavy chain is a "regular" Fab format, comprising a variable heavy chain and a light chain. This structure is sometimes referred to herein as "triple F" format (scFv-Fab-Fc) or the "bottle-opener" (BO) format, due to a rough visual similarity to a bottle-opener (see FIG. 1A). The two chains are brought together by the use of amino acid variants in the constant regions (e.g. the Fc domain, the CH1 domain and/or the hinge region) that promote the formation of heterodimeric antibodies as is described more fully below.

There are several distinct advantages to the present "triple F" format. As is known in the art, antibody analogs relying on two scFv constructs often have stability and aggregation problems, which can be alleviated in the present invention by the addition of a "regular" heavy and light chain pairing. In addition, as opposed to formats that rely on two heavy chains and two light chains, there is no issue with the incorrect pairing of heavy and light chains (e.g. heavy 1 pairing with light 2, etc.).

Many of the embodiments outlined herein rely in general on the bottle opener format that comprises a first monomer comprising an scFv (sometimes referred to herein as the "scFv monomer" or "scFv chain" of the BO format), comprising a variable heavy and a variable light domain, covalently attached using an scFv linker (charged, in many but not all instances), where the scFv is covalently attached to the N-terminus of a first Fc domain usually through a domain linker (which, as outlined herein can either be un-charged or charged and can be exogeneous or endogeneous (e.g. all or part of the native hinge domain). Thus the scFv monomer can have, from N-terminal to C-terminal, a structure selected from VH1-scFv linker-VL1-optional linker-CH2-CH3, VL1-scFv linker-VH1-optional linker-CH2-CH3, VH1-scFv linker-VL1-hinge-CH2-CH3 and VL1-scFv linker-VH1-hinge-CH2-CH3. The second monomer of the bottle opener format is a heavy chain (VH2-CH1-hinge-CH2-CH3), and the composition further comprises a light chain (VL2-CL).

In addition, the Fc domains of the bottle opener format generally comprise skew variants (e.g. a set of amino acid substitutions as shown in FIG. 3A-3F and FIG. 8, with particularly useful skew variants being selected from the group consisting of S364K/E357Q: L368D/K370S; L368D/K370S: S364K; L368E/K370S: S364K; T411T/E360E/Q362E: D401K; L368D/K370S: S364K/E357L, K370S: S364K/E357Q, T366S/L368A/Y407V: T366W and T366S/L368A/Y407V/Y349C: T366W/S354C), optionally ablation variants (including those shown in FIG. 5), optionally charged scFv linkers (including those shown in FIGS. 7A-7B) and the heavy chain comprises pI variants (including those shown in FIG. 4).

In some embodiments, the bottle opener format includes skew variants, pI variants, and ablation variants. Accordingly, some embodiments include bottle opener formats that comprise: a) a first monomer (the "scFv monomer") that comprises a charged scFv linker (with the +H sequence of FIGS. 7A-7B being preferred in some embodiments), the skew variants S364K/E357Q, the ablation variants E233P/L234V/L235A/G236del/S267K, and an Fv that binds to PD-1 as outlined herein; b) a second monomer (the "Fab monomer") that comprises the skew variants L368D/K370S, the pI variants N208D/Q295E/N384D/Q418E/N421D, the ablation variants E233P/L234V/L235A/G236del/S267K, and a variable heavy domain that, with the variable light domain, makes up an Fv that binds to a second antigen as outlined herein; and c) a light chain.

A number of suitable combinations are outlined in WO2017/218707 for this format. Generally, the present invention is directed to the use of new anti-PD-1 ABDs based on a newly identified done, 1C11. In this case, the heterodimeric antibodies bind to PD-1 and a second target antigen selected from the group consisting of CTLA-4, LAG-3, TIM-3, BTLA, TIGIT (all of which are classified as checkpoint receptors) and ICOS (which is an activator).

In some embodiments, the anti-PD-1 ABD is the scFv side of the bottle opener format. Thus, suitable ABD pairs include (scFv first, Fab second), PD-1 X CTLA-4, PD-1 X LAG-3, PD-1 X TIM-3, PD-1 X BTLA, PD-1 X TIGIT and PD-1 X ICOS. Suitable CDR sets as well as ABDs are described below, with particularly useful combinations similarly described below.

In some embodiments, the bottle opener format includes skew variants, pI variants, ablation variants and FcRn variants. Accordingly, some embodiments include bottle opener formats that comprise: a) a first monomer (the "scFv monomer") that comprises a charged scFv linker (with the +H sequence of FIGS. 7A-7B being preferred in some embodiments), the skew variants S364K/E357Q, the ablation variants E233P/L234V/L235A/G236del/S267K, the FcRn variants M428L/N434S and an Fv that binds to PD-1 as outlined herein; b) a second monomer (the "Fab monomer") that comprises the skew variants L368D/K370S, the pI variants N208D/Q295E/N384D/Q418E/N421D, the ablation variants E233P/L234V/L235A/G236del/S267K, the FcRn variants M428L/N434S and a variable heavy domain that, with the variable light domain, makes up an Fv that binds to anantigen as outlined herein; and c) a light chain.

Specifically, FIGS. 50A-50E shows some bottle opener "skeleton" sequences that have a PD-1 scFv monomer but are missing the Fab sequences that can be used on the other side. That is, Fv sequences for the Fab portion of any ABD for CTLA-4, TIM-3, LAG-3, BTLA-, TIGIT and ICOS as discussed herein.

Specific bottle opener embodiments are outlined below.

B. mAb-Fv

One heterodimeric scaffold that finds particular use in the present invention is the mAb-Fv format shown in FIG. 1. In this embodiment, the format relies on the use of a C-terminal attachment of an "extra" variable heavy domain to one monomer and the C-terminal attachment of an "extra" variable light domain to the other monomer, thus forming a third antigen binding domain, wherein the Fab portions of the two monomers bind a target antigen as outlined herein and the "extra" scFv domain binds PD-1.

In this embodiment, the first monomer comprises a first heavy chain, comprising a first variable heavy domain and a first constant heavy domain comprising a first Fc domain, with a first variable light domain covalently attached to the C-terminus of the first Fc domain using a domain linker (vh1-CH1-hinge-CH2-CH3-[optional linker]-v12). The second monomer comprises a second variable heavy domain of the second constant heavy domain comprising a second Fc domain, and a third variable heavy domain covalently attached to the C-terminus of the second Fc domain using a domain linker (vj1-CH1-hinge-CH2-CH3-[optional linker]-vh2. The two C-terminally attached variable domains make up a Fv that binds PD-1. This embodiment further utilizes a common light chain comprising a variable light domain and a constant light domain that associates with the heavy chains to form two identical Fabs that bind a target antigen. As for many of the embodiments herein, these constructs include skew variants, pI variants, ablation variants, additional Fc variants, etc. as desired and described herein.

In addition, the Fc domains of the mAb-Fv format comprise skew variants (e.g. a set of amino acid substitutions as shown in FIGS. 3 and 8, with particularly useful skew variants being selected from the group consisting of S364K/E357Q: L368D/K370S; L368D/K370S: S364K; L368E/K370S: S364K; T411T/E360E/Q362E: D401K; L368D/K370S: S364K/E357L, K370S: S364K/E357Q, T366S/L368A/Y407V: T366W and T366S/L368A/Y407V/Y349C: T366W/S354C), optionally ablation variants (including those shown in FIG. 5), optionally charged scFv linkers (including those shown in FIG. 7) and the heavy chain comprises pI variants (including those shown in FIG. 4).

In some embodiments, the mAb-Fv format includes skew variants, pI variants, and ablation variants. Accordingly, some embodiments include mAb-Fv formats that comprise: a) a first monomer that comprises the skew variants S364K/E357Q, the ablation variants E233P/L234V/L235A/G236del/S267K, and a first variable heavy domain that, with the first variable light domain of the light chain, makes up an Fv, and a second variable heavy domain; b) a second monomer that comprises the skew variants L368D/K370S, the pI variants N208D/Q295E/N384D/Q418E/N421D, the ablation variants E233P/L234V/L235A/G236del/S267K, and a first variable heavy domain that, with the first variable light domain, makes up the Fv, and a second variable light chain, that together with the second variable heavy domain forms an Fv (ABD) that binds to PD-1; and c) a light chain comprising a first variable light domain and a constant light domain.

In some embodiments, the mAb-Fv format includes skew variants, pI variants, ablation variants and FcRn variants. Accordingly, some embodiments include mAb-Fv formats that comprise: a) a first monomer that comprises the skew variants S364K/E357Q, the ablation variants E233P/L234V/L235A/G236del/S267K, the FcRn variants M428L/N434S and a first variable heavy domain that, with the first variable light domain of the light chain, makes up an Fv that binds to an antigen, and a second variable heavy domain; b) a second monomer that comprises the skew variants L368D/K370S, the pI variants N208D/Q295E/N384D/Q418E/N421D, the ablation variants E233P/L234V/L235A/G236del/S267K, the FcRn variants M428L/N434S and a first variable heavy domain that, with the first variable light domain, makes up the Fv that binds to the antigen as outlined herein, and a second variable light chain, that together with the second variable heavy domain of the first monomer forms an Fv (ABD) that binds PD-1; and c) a light chain comprising a first variable light domain and a constant light domain.

C. mAb-scFv

One heterodimeric scaffold that finds particular use in the present invention is the mAb-scFv format shown in FIG. 1. In this embodiment, the format relies on the use of a C-terminal attachment of a scFv to one of the monomers, thus forming a third antigen binding domain, wherein the Fab portions of the two monomers bind one of the antigens outlined herein and the "extra" scFv domain binds PD-1. Thus, the first monomer comprises a first heavy chain (comprising a variable heavy domain and a constant domain), with a C-terminally covalently attached scFv comprising a scFv variable light domain, an scFv linker and a scFv variable heavy domain in either orientation (vh1-CH1-hinge-CH2-CH3-[optional linker]-vh2-scFv linker-v12 or vh1-CH1-hinge-CH2-CH3-[optional linker]-v12-scFv linker-vh2). This embodiment further utilizes a common light chain comprising a variable light domain and a constant light domain, that associates with the heavy chains to form two identical Fabs that bind the antigen. As for many of the embodiments herein, these constructs include skew variants, pI variants, ablation variants, additional Fc variants, etc. as desired and described herein.

In addition, the Fc domains of the mAb-scFv format comprise skew variants (e.g. a set of amino acid substitutions as shown in FIGS. 3 and 8, with particularly useful skew variants being selected from the group consisting of S364K/E357Q: L368D/K370S; L368D/K370S: S364K; L368E/K370S: S364K; T411T/E360E/Q362E: D401K; L368D/K370S: S364K/E357L, K370S: S364K/E357Q, T366S/L368A/Y407V: T366W and T366S/L368A/Y407V/Y349C: T366W/S354C), optionally ablation variants (including those shown in FIG. 5), optionally charged scFv linkers (including those shown in FIG. 7) and the heavy chain comprises pI variants (including those shown in FIG. 4).

In some embodiments, the mAb-scFv format includes skew variants, pI variants, and ablation variants. Accordingly, some embodiments include mAb-scFv formats that comprise: a) a first monomer that comprises the skew variants S364K/E357Q, the ablation variants E233P/L234V/L235A/G236del/S267K, and a variable heavy domain that, with the variable light domain of the common light chain, makes up an Fv that binds to a target antigen as outlined herein, and a scFv domain that binds to PD-1; b) a second monomer that comprises the skew variants L368D/K370S, the pI variants N208D/Q295E/N384D/Q418E/N421D, the ablation variants E233P/L234V/L235A/G236del/S267K, and a variable heavy domain that, with the variable light domain of the common light chain, makes up an Fv that binds to the target antigen as outlined herein; and c) a common light chain comprising a variable light domain and a constant light domain.

In some embodiments, the mAb-scFv format includes skew variants, pI variants, ablation variants and FcRn variants. Accordingly, some embodiments include mAb-scFv formats that comprise: a) a first monomer that comprises the skew variants S364K/E357Q the ablation variants E233P/L234V/L235A/G236del/S267K, the FcRn variants M428L/N434S and a variable heavy domain that, with the variable light domain of the common light chain, makes up an Fv that binds to an antigen as outlined herein, and a scFv domain that binds to PD-1; b) a second monomer that comprises the skew variants L368D/K370S, the pI variants N208D/Q295E/N384D/Q418E/N421D, the ablation variants E233P/L234V/L235A/G236del/S267K, the FcRn variants M428L/N434S and a variable heavy domain that, with the variable light domain of the common light chain, makes up an Fv that binds to an antigen as outlined herein; and c) a common light chain comprising a variable light domain and a constant light domain.

D. Central-scFv

One heterodimeric scaffold that finds particular use in the present invention is the Central-scFv format shown in FIG. 1 (also sometimes referred to as the "2+1" format). In this embodiment, the format relies on the use of an inserted scFv domain thus forming a third antigen binding domain, wherein the Fab portions of the two monomers bind a target antigen and the "extra" scFv domain binds PD-1. The scFv domain is inserted between the Fc domain and the CH1-Fv region of one of the monomers, thus providing a third antigen binding domain. This can actually be thought of as an addition to the bottle opener format, wherein there is an additional VH-CH1 domain added to the N-terminus of the scFv, which utilizes a common light chain.

In this embodiment, one monomer comprises a first heavy chain comprising a first variable heavy domain, a CH1 domain (and optional hinge) and Fc domain, with a scFv comprising a scFv variable light domain, an scFv linker and a scFv variable heavy domain. The scFv is covalently attached between the C-terminus of the CH1 domain of the heavy constant domain and the N-terminus of the first Fc domain using optional domain linkers (vh1-CH1-[optional linker]-vh2-scFv linker-v12-[optional linker including the hinge]-CH2-CH3, or the opposite orientation for the scFv, vh1-CH1-[optional linker]-v12-scFv linker-vh2-[optional linker including the hinge]-CH2-CH3). The other monomer is a standard Fab side. This embodiment further utilizes a common light chain comprising a variable light domain and a constant light domain, that associates with the heavy chains to form two identical Fabs that bind a target antigen. As for many of the embodiments herein, these constructs include skew variants, pI variants, ablation variants, additional Fc variants, etc. as desired and described herein.

In addition, the Fc domains of the central scFv format comprise skew variants (e.g. a set of amino acid substitutions as shown in FIGS. 3 and 8, with particularly useful skew variants being selected from the group consisting of S364K/E357Q: L368D/K370S; L368D/K370S: S364K; L368E/K370S: S364K; T411T/E360E/Q362E: D401K; L368D/K370S: S364K/E357L, K370S: S364K/E357Q, T366S/L368A/Y407V: T366W and T366S/L368A/Y407V/Y349C: T366W/S354C), optionally ablation variants (including those shown in FIG. 5), optionally charged scFv linkers (including those shown in FIG. 7) and the heavy chain comprises pI variants (including those shown in FIG. 4).

In some embodiments, the central-scFv format includes skew variants, pI variants, and ablation variants. Accordingly, some embodiments include central scFv formats that comprise: a) a first monomer that comprises the skew variants S364K/E357Q, the ablation variants E233P/L234V/L235A/G236del/S267K, and a variable heavy domain that, with the variable light domain of the light chain, makes up an Fv that binds to a target antigen as outlined herein, and an scFv domain that binds to PD-1; b) a second monomer that comprises the skew variants L368D/K370S, the pI variants N208D/Q295E/N384D/Q418E/N421D, the ablation variants E233P/L234V/L235A/G236del/S267K, and a variable heavy domain that, with variable light domain of the light chain, makes up an Fv that binds to a target antigen as outlined herein; and c) a light chain comprising a variable light domain and a constant light domain.

In some embodiments, the central-scFv format includes skew variants, pI variants, ablation variants and FcRn variants. Accordingly, some embodiments include central scFv formats that comprise: a) a first monomer that comprises the skew variants S364K/E357Q, the ablation variants E233P/L234V/L235A/G236del/S267K, the FcRn variants M428L/N434S and a variable heavy domain that, with the variable light domain of the light chain, makes up an Fv that binds to a target antigen as outlined herein, and an scFv domain that binds to PD-1; b) a second monomer that comprises the skew variants L368D/K370S, the pI variants N208D/Q295E/N384D/Q418E/N421D, the ablation variants E233P/L234V/L235A/G236del/S267K, the FcRn variants M428L/N434S and a variable heavy domain that, with variable light domain of the light chain, makes up an Fv that binds to SSTR2 as outlined herein; and c) a light chain comprising a variable light domain and a constant light domain.

E. Central-Fv

One heterodimeric scaffold that finds particular use in the present invention is the Central-Fv format shown in FIG. 1G. In this embodiment, the format relies on the use of an inserted Fv domain (i.e., the central Fv domian) thus forming a third antigen binding domain, wherein the Fab portions of the two monomers bind a target antigen and the "central Fv" domain binds PD-1. The scFv domain is inserted between the Fc domain and the CH1-Fv region of the monomers, thus providing a third antigen binding domain, wherein each monomer contains a component of the scFv (e.g. one monomer comprises a variable heavy domain and the other a variable light domain).

In this embodiment, one monomer comprises a first heavy chain comprising a first variable heavy domain, a CH1 domain, and Fc domain and an additional variable light domain. The light domain is covalently attached between the C-terminus of the CH1 domain of the heavy constant domain and the N-terminus of the first Fc domain using domain linkers (vh1-CH1-[optional linker]-v12-hinge-CH2-CH3). The other monomer comprises a first heavy chain comprising a first variable heavy domain, a CH1 domain and Fc domain and an additional variable heavy domain (vh1-CH1-[optional linker]-vh2-hinge-CH2-CH3). The light domain is covalently attached between the C-terminus of the CH1 domain of the heavy constant domain and the N-terminus of the first Fc domain using domain linkers.

This embodiment further utilizes a common light chain comprising a variable light domain and a constant light domain, that associates with the heavy chains to form two identical Fabs that bind a target antigen. As for many of the embodiments herein, these constructs include skew variants, pI variants, ablation variants, additional Fc variants, etc. as desired and described herein.

F. One Armed Central-scFv

One heterodimeric scaffold that finds particular use in the present invention is the one armed central-scFv format shown in FIG. 1. In this embodiment, one monomer comprises just an Fc domain, while the other monomer uses an inserted scFv domain thus forming the second antigen binding domain. In this format, either the Fab portion binds a target antigen and the scFv binds PD-1 or vice versa. The scFv domain is inserted between the Fc domain and the CH1-Fv region of one of the monomers.

In this embodiment, one monomer comprises a first heavy chain comprising a first variable heavy domain, a CH1 domain and Fc domain, with a scFv comprising a scFv variable light domain, an scFv linker and a scFv variable heavy domain. The scFv is covalently attached between the C-terminus of the CH1 domain of the heavy constant domain and the N-terminus of the first Fc domain using domain linkers. The second monomer comprises an Fc domain. This embodiment further utilizes a light chain comprising a variable light domain and a constant light domain, that associates with the heavy chain to form a Fab. As for many of the embodiments herein, these constructs include skew variants, pI variants, ablation variants, additional Fc variants, etc. as desired and described herein.

In addition, the Fc domains of the one armed central-scFv format generally include skew variants (e.g. a set of amino acid substitutions as shown in FIGS. 3 and 8, with particularly useful skew variants being selected from the group consisting of S364K/E357Q: L368D/K370S; L368D/K370S: S364K; L368E/K370S: S364K; T411T/E360E/Q362E: D401K; L368D/K370S: S364K/E357L, K370S: S364K/E357Q, T366S/L368A/Y407V: T366W and T366S/L368A/Y407V/Y349C: T366W/S354C), optionally ablation variants (including those shown in FIG. 5), optionally charged scFv linkers (including those shown in FIG. 7) and the heavy chain comprises pI variants (including those shown in FIG. 4).

In some embodiments, the one armed central-scFv format includes skew variants, pI variants, and ablation variants. Accordingly, some embodiments of the one armed central-scFv formats comprise: a) a first monomer that comprises the skew variants S364K/E357Q the ablation variants E233P/L234V/L235A/G236del/S267K, and a variable heavy domain that, with the variable light domain of the light chain, makes up an Fv that binds to a target antigen as outlined herein, and a scFv domain that binds to PD-1; b) a second monomer that includes an Fc domain having the skew variants L368D/K370S, the pI variants N208D/Q295E/N384D/Q418E/N421D, the ablation variants E233P/L234V/L235A/G236del/S267K; and c) a light chain comprising a variable light domain and a constant light domain.

In some embodiments, the one armed central-scFv format includes skew variants, pI variants, ablation variants and FcRn variants. Accordingly, some embodiments of the one armed central-scFv formats comprise: a) a first monomer that comprises the skew variants S364K/E357Q, the ablation variants E233P/L234V/L235A/G236del/S267K, the FcRn variants M428L/N434S and a variable heavy domain that, with the variable light domain of the light chain, makes up an Fv that binds to a target antigen as outlined herein, and a scFv domain that binds to PD-1; b) a second monomer that includes an Fc domain having the skew variants L368D/K370S, the pI variants N208D/Q295E/N384D/Q418E/N421D, the ablation variants E233P/L234V/L235A/G236del/S267K, and the FcRn variants M428L/N434S; and c) a light chain comprising a variable light domain and a constant light domain.

G. One Armed scFv-mAb

One heterodimeric scaffold that finds particular use in the present invention is the one armed scFv-mAb format shown in FIG. 1. In this embodiment, one monomer comprises just an Fc domain, while the other monomer uses a scFv domain attached at the N-terminus of the heavy chain, generally through the use of a linker: vh-scFv linker-vl-[optional domain linker]-CH1-hinge-CH2-CH3 or (in the opposite orientation) vl-scFv linker-vh-[optional domain linker]-CH1-hinge-CH2-CH3. In this format, the Fab portions each bind a target antigen and the scFv binds PD-1. This embodiment further utilizes a light chain comprising a variable light domain and a constant light domain, that associates with the heavy chain to form a Fab. As for many of the embodiments herein, these constructs include skew variants, pI variants, ablation variants, additional Fc variants, etc. as desired and described herein.

In addition, the Fc domains of the one armed scFv-mAb format generally include skew variants (e.g. a set of amino acid substitutions as shown in FIGS. 3 and 8, with particularly useful skew variants being selected from the group consisting of S364K/E357Q: L368D/K370S; L368D/K370S: S364K; L368E/K370S: S364K; T411T/E360E/Q362E: D401K; L368D/K370S: S364K/E357L, K370S: S364K/E357Q, T366S/L368A/Y407V: T366W and T366S/L368A/Y407V/Y349C: T366W/S354C), optionally ablation variants (including those shown in FIG. 5), optionally charged scFv linkers (including those shown in FIG. 7) and the heavy chain comprises pI variants (including those shown in FIG. 4).

In some embodiments, the one armed scFv-mAb format includes skew variants, pI variants, and ablation variants. Accordingly, some embodiments of the one armed scFv-mAb formats comprise: a) a first monomer that comprises the skew variants S364K/E357Q, the ablation variants E233P/L234V/L235A/G236del/S267K, and a variable heavy domain that, with the variable light domain of the light chain, makes up an Fv that binds to a target antigen as outlined herein, and a scFv domain that binds to PD-1; b) a second monomer that includes an Fc domain having the skew variants L368D/K370S, the pI variants N208D/Q295E/N384D/Q418E/N421D, the ablation variants E233P/L234V/L235A/G236del/S267K; and c) a light chain comprising a variable light domain and a constant light domain.

In some embodiments, the one armed scFv-mAb format includes skew variants, pI variants, ablation variants and FcRn variants. Accordingly, some embodiments one armed scFv-mAb formats comprise: a) a first monomer that comprises the skew variants S364K/E357Q, the ablation variants E233P/L234V/L235A/G236del/S267K, the FcRn variants M428L/N434S and a variable heavy domain that, with the variable light domain of the light chain, makes up an Fv that binds to a target antigen as outlined herein, and a scFv domain that binds to PD-1; b) a second monomer that includes an Fc domain having the skew variants L368D/K370S, the pI variants N208D/Q295E/N384D/Q418E/N421D, the ablation variants E233P/L234V/L235A/G236del/S267K, and the FcRn variants M428L/N434S; and c) a light chain comprising a variable light domain and a constant light domain.

H. scFv-mAb

One heterodimeric scaffold that finds particular use in the present invention is the mAb-scFv format shown in FIG. 1E. In this embodiment, the format relies on the use of a N-terminal attachment of a scFv to one of the monomers, thus forming a third antigen binding domain, wherein the Fab portions of the two monomers bind a target antigen and the "extra" scFv domain binds PD-1.

In this embodiment, the first monomer comprises a first heavy chain (comprising a variable heavy domain and a constant domain), with a N-terminally covalently attached scFv comprising a scFv variable light domain, an scFv linker and a scFv variable heavy domain in either orientation ((vh1-scFv linker-vl1-[optional domain linker]-vh2-CH1-hinge-CH2-CH3) or (with the scFv in the opposite orientation) ((vl1-scFv linker-vh1-[optional domain linker]-vh2-CH1-hinge-CH2-CH3)). This embodiment further utilizes a common light chain comprising a variable light domain and a constant light domain that associates with the heavy chains to form two identical Fabs that bind the target. As for many of the embodiments herein, these constructs include skew variants, pI variants, ablation variants, additional Fc variants, etc. as desired and described herein.

In addition, the Fc domains of the scFv-mAb format generally include skew variants (e.g. a set of amino acid substitutions as shown in FIGS. 3 and 8, with particularly useful skew variants being selected from the group consisting of S364K/E357Q: L368D/K370S; L368D/K370S: S364K; L368E/K370S: S364K; T411T/E360E/Q362E: D401K; L368D/K370S: S364K/E357L, K370S: S364K/E357Q, T366S/L368A/Y407V: T366W and T366S/L368A/Y407V/Y349C: T366W/S354C), optionally ablation variants (including those shown in FIG. 5), optionally charged scFv linkers (including those shown in FIG. 7) and the heavy chain comprises pI variants (including those shown in FIG. 4).

In some embodiments, the scFv-mAb format includes skew variants, pI variants, and ablation variants. Accordingly, some embodiments include scFv-mAb formats that comprise: a) a first monomer that comprises the skew variants S364K/E357Q, the ablation variants E233P/L234V/L235A/G236del/S267K, and a variable heavy domain that, with the variable light domain of the common light chain, makes up an Fv that binds to the target as outlined herein, and a scFv domain that binds to PD-1; b) a second monomer that comprises the skew variants L368D/K370S, the pI variants N208D/Q295E/N384D/Q418E/N421D, the ablation variants E233P/L234V/L235A/G236del/S267K, and a variable heavy domain that, with the variable light domain of the common light chain, makes up an Fv that binds to the target antigen as outlined herein; and c) a common light chain comprising a variable light domain and a constant light domain.

In some embodiments, the scFv-mAb format includes skew variants, pI variants, ablation variants and FcRn variants. Accordingly, some embodiments include scFv-mAb formats that comprise: a) a first monomer that comprises the skew variants S364K/E357Q, the ablation variants E233P/L234V/L235A/G236del/S267K, the FcRn variants M428L/N434S and a variable heavy domain that, with the variable light domain of the common light chain, makes up an Fv that binds to the target antigen as outlined herein, and a scFv domain that binds to PD-1; b) a second monomer that comprises the skew variants L368D/K370S, the pI variants N208D/Q295E/N384D/Q418E/N421D, the ablation variants E233P/L234V/L235A/G236del/S267K, the FcRn variants M428L/N434S and a variable heavy domain that, with the variable light domain of the common light chain, makes up an Fv that binds to the target as outlined herein; and c) a common light chain comprising a variable light domain and a constant light domain.

I. Dual scFv Formats

The present invention also provides dual scFv formats as are known in the art and shown in FIG. 1B. In this embodiment, the SSTR2 x CD3 heterodimeric bispecific antibody is made up of two scFv-Fc monomers (both in either (vh-scFv linker-vl-[optional domain linker]-CH2-CH3) format or (vl-scFv linker-vh-[optional domain linker]-CH2-CH3) format, or with one monomer in one orientation and the other in the other orientation.

In some embodiments, the dual scFv format includes skew variants, pI variants, and ablation variants. Accordingly, some embodiments include dual scFv formats that comprise: a) a first monomer that comprises the skew variants S364K/E357Q, the ablation variants E233P/L234V/L235A/G236del/S267K, and a first scFv that binds either PD-1 or the target antigen; and b) a second monomer that comprises the skew variants L368D/K370S, the pI variants N208D/Q295E/N384D/Q418E/N421D, the ablation variants E233P/L234V/L235A/G236del/S267K, and a second scFv that binds either PD-1 or the other target antigen.

In some embodiments, the dual scFv format includes skew variants, pI variants, ablation variants and FcRn variants. In some embodiments, the dual scFv format includes skew variants, pI variants, and ablation variants. Accordingly, some embodiments include dual scFv formats that comprise: a) a first monomer that comprises the skew variants S364K/E357Q, the ablation variants E233P/L234V/L235A/G236del/S267K, the FcRn variants M428L/N434S and a first scFv; and b) a second monomer that comprises the skew variants L368D/K370S, the pI variants N208D/Q295E/N384D/Q418E/N421D, the ablation variants E233P/L234V/L235A/G236del/S267K, the FcRn variants M428L/N434S and a second scFv.

XI. PARTICULAR EMBODIMENTS OF THE INVENTION

As will be appreciated by those in the art, the invention provides a large number of possible combinations of anti-PD-1 scFv sequences with the ABDs for different target antigens in the different formats of the invention.

In some embodiments, any PD-1 ABD of FIGS. 13, 15, 16,18, 20, 21, 24, 33 and 40 can be combined with any anti-TIM-3 ABD, any anti-CTLA-4 ABD, any anti-ICOS ABD, any anti-TIM-3 ABD, any anti-LAG-3 ABD or any anti-BTLA ABD, in any format of FIG. 1. Of particular use are anti-PD-1 scFv sequences of FIG. 15 in combination with Fab ABDs of the sequence listing for these ABDs. In some embodiments, these combinations are made using the "backbone" sequences for the bottle opener format as depicted in FIG. 162 of US Publication No. 2016/0355608 (which can also be used for the Central-scFv format), or using the "backbone" sequences for the "mAb-scFv" format as depicted in FIG. 163 of US Publication No. 2016/0355608, both Figures of which (and the accompanying legends) are expressly incorporated by reference herein.

A. PD-1 X CTLA-4 Bottle Opener Embodiments

In some embodiments, the invention provides bispecific heterodimeric antibodies that bind to both human PD-1 and human CTLA-4. As will be appreciated by those in the art, there are a large number of possible combinations of anti-PD-1 scFv sequences with the ABDs for CTLA-4.

In some embodiments, the PD-1 ABD is the scFv and the CTLA-4 ABD is the Fab construct. In these embodiments, any scFv ABD from FIG. 15 A-15T can be combined with any anti-CTLA-4 ABD sequence. Anti-CTLA-4 ABDs sequences suitable for use in the present invention include SEQ ID NOs: 21-2918 (CTLA-4 scFv sequences, although the Fv sequences therein can be formatted as Fabs), SEQ ID NOs: 2919-6208 (CTLA-4 Fab sequences, although the Fv sequences therein can be formatted as scFvs), SEQ ID NOs: 36739-36818 (additional CTLA-4 Fab sequences, although the Fv sequences therein can be formatted as scFvs) and SEQ ID NOs: 35395-35416 (CTLA-4 one armed constructs, which can be formatted as either Fabs or scFvs). As will be understood from those in the art, these sequence identifiers come in "pairs" for the variable heavy and light chains, as will be apparent from the sequence identifiers.

In some embodiments, heterodimeric antibodies of the invention are made in the bottle opener format using a PD-1 ABD from FIG. 15 as the scFv and the CTLA-4 ABD as the Fab Fv, when the CTLA-4 ABD is selected from a pair from SEQ ID NOs:2919-6208 and SEQ ID NOs:35395-35416 of the present sequencing listing. In some embodiments, the VH domain of the CTLA-4 Fab is added to SEQ ID NO:471, the VL of the CTLA-4 Fab is added to SEQ ID NO:473 and the PD-1 scFv is added to SEQ ID NO:472 of US2016/0355608. In some embodiments, the VH domain of the CTLA-4 Fab is added to SEQ ID NO:474, the $V_L$ of the CTLA-4 Fab is added to SEQ ID NO:476 and the PD-1 scFv is added to SEQ ID NO:475 of US2016/0355608. In some embodiments, the VH domain of the CTLA-4 Fab is added to SEQ ID NO:477, the VL of the CTLA-4 Fab is added to SEQ ID NO:479 and the PD-1 scFv is added to SEQ ID NO:478 of US2016/0355608. In some embodiments, the VH domain of the CTLA-4 Fab is added to SEQ ID NO:480, the VL of the CTLA-4 Fab is added to SEQ ID NO:482 and the PD-1 scFv is added to SEQ ID NO:481 of US2016/0355608.

In some embodiments, the CTLA-4 Fab comprises a variable heavy domain of SEQ ID NO:38134 and a variable light domain of SEQ ID NO:38138.

In some embodiments, an anti-CTLA-4 Fab is selected from any of SEQ ID NOs: 2919-6208 and SEQ ID NOs: 36739-36818 herein, with the CTLA-4 Fab comprising a variable heavy domain of SEQ ID NO:38134 and a variable light domain of SEQ ID NO:38138 finding particular use. In these embodiments, the remainder of the heterodimeric antibody is XENCS556 from FIG. 50; that is, the VH from the CTLA-4 Fab is added N-terminally to the Fab Chain of XENCS556 and the VL from the CTLA-4 Fab is added N-terminally to the Light Chain of XENCS556.

In some embodiments, an anti-CTLA-4 Fab is selected from any of SEQ ID NOs: 2919-6208 and SEQ ID NOs: 36739-36818 herein, with the CTLA-4 Fab comprising a variable heavy domain of SEQ ID NO:38134 and a variable light domain of SEQ ID NO:38138 finding particular use. In these embodiments, the remainder of the heterodimeric antibody is XENCS557 from FIG. 50; that is, the VH from the CTLA-4 Fab is added N-terminally to the Fab Chain of XENCS557 and the VL from the CTLA-4 Fab is added N-terminally to the Light Chain of XENCS557.

In some embodiments, an anti-CTLA-4 Fab is selected from any of SEQ ID NOs: 2919-6208 and SEQ ID NOs: 36739-36818 herein, with the CTLA-4 Fab comprising a variable heavy domain of SEQ ID NO:38134 and a variable light domain of SEQ ID NO:38138 finding particular use. In these embodiments, the remainder of the heterodimeric antibody is XENCS558 from FIG. 50; that is, the VH from the CTLA-4 Fab is added N-terminally to the Fab Chain of XENCS558 and the VL from the CTLA-4 Fab is added N-terminally to the Light Chain of XENCS558.

In some embodiments, an anti-CTLA-4 Fab is selected from any of SEQ ID NOs: 2919-6208 and SEQ ID NOs: 36739-36818 herein, with the CTLA-4 Fab comprising a variable heavy domain of SEQ ID NO:38134 and a variable light domain of SEQ ID NO:38138 finding particular use. In these embodiments, the remainder of the heterodimeric antibody is XENCS559 from FIG. 50; that is, the VH from the CTLA-4 Fab is added N-terminally to the Fab Chain of XENCS559 and the VL from the CTLA-4 Fab is added N-terminally to the Light Chain of XENCS559.

In some embodiments, an anti-CTLA-4 Fab is selected from any of SEQ ID NOs: 2919-6208 and SEQ ID NOs: 36739-36818 herein, with the CTLA-4 Fab comprising a variable heavy domain of SEQ ID NO:38134 and a variable light domain of SEQ ID NO:38138 finding particular use. In these embodiments, the remainder of the heterodimeric antibody is XENCS560 from FIG. 50; that is, the VH from the CTLA-4 Fab is added N-terminally to the Fab Chain of XENCS560 and the VL from the CTLA-4 Fab is added N-terminally to the Light Chain of XENCS560.

In some embodiments, an anti-CTLA-4 Fab is selected from any of SEQ ID NOs: 2919-6208 and SEQ ID NOs: 36739-36818 herein, with the CTLA-4 Fab comprising a variable heavy domain of SEQ ID NO:38134 and a variable light domain of SEQ ID NO:38138 finding particular use. In these embodiments, the remainder of the heterodimeric antibody is XENCS561 from FIG. 50; that is, the VH from the CTLA-4 Fab is added N-terminally to the Fab Chain of XENCS561 and the VL from the CTLA-4 Fab is added N-terminally to the Light Chain of XENCS561.

In some embodiments, an anti-CTLA-4 Fab is selected from any of SEQ ID NOs: 2919-6208 and SEQ ID NOs: 36739-36818 herein, with the CTLA-4 Fab comprising a variable heavy domain of SEQ ID NO:38134 and a variable light domain of SEQ ID NO:38138 finding particular use. In these embodiments, the remainder of the heterodimeric antibody is XENCS562 from FIG. 50; that is, the VH from the CTLA-4 Fab is added N-terminally to the Fab Chain of XENCS562 and the VL from the CTLA-4 Fab is added N-terminally to the Light Chain of XENCS562.

In some embodiments, an anti-CTLA-4 Fab is selected from any of SEQ ID NOs: 2919-6208 and SEQ ID NOs: 36739-36818 herein, with the CTLA-4 Fab comprising a variable heavy domain of SEQ ID NO:38134 and a variable light domain of SEQ ID NO:38138 finding particular use. In these embodiments, the remainder of the heterodimeric antibody is XENCS563 from FIG. 50; that is, the VH from the CTLA-4 Fab is added N-terminally to the Fab Chain of XENCS563 and the VL from the CTLA-4 Fab is added N-terminally to the Light Chain of XENCS563.

In some embodiments, an anti-CTLA-4 Fab is selected from the pairs of SEQ ID NOs:36739 and 36743, 36747 and 36751, 36755 and 36759, 36763 and 36767, 36771 and 36775, 36779 and 36783, 36787 and 36791, 36795 and 36799, 36803 and 36807 and 36811 and 36815 of the sequence listing. In these embodiments, the remainder of the heterodimeric antibody is XENCS556 from FIG. 50; that is, the VH from the CTLA-4 Fab is added N-terminally to the Fab Chain of XENCS556 and the VL from the CTLA-4 Fab is added N-terminally to the Light Chain of XENCS556.

In some embodiments, an anti-CTLA-4 Fab is selected from the pairs of SEQ ID NOs:36739 and 36743, 36747 and 36751, 36755 and 36759, 36763 and 36767, 36771 and 36775, 36779 and 36783, 36787 and 36791, 36795 and 36799, 36803 and 36807 and 36811 and 36815 of the sequence listing. In these embodiments, the remainder of the heterodimeric antibody is XENCS557 from FIG. 50; that is, the VH from the CTLA-4 Fab is added N-terminally to the Fab Chain of XENCS557 and the VL from the CTLA-4 Fab is added N-terminally to the Light Chain of XENCS557.

In some embodiments, an anti-CTLA-4 Fab is selected from the pairs of SEQ ID NOs:36739 and 36743, 36747 and 36751, 36755 and 36759, 36763 and 36767, 36771 and 36775, 36779 and 36783, 36787 and 36791, 36795 and 36799, 36803 and 36807 and 36811 and 36815 of the sequence listing. In these embodiments, the remainder of the heterodimeric antibody is XENCS558 from FIG. 50; that is, the VH from the CTLA-4 Fab is added N-terminally to the Fab Chain of XENCS558 and the VL from the CTLA-4 Fab is added N-terminally to the Light Chain of XENCS558.

In some embodiments, an anti-CTLA-4 Fab is selected from the pairs of SEQ ID NOs:36739 and 36743, 36747 and 36751, 36755 and 36759, 36763 and 36767, 36771 and 36775, 36779 and 36783, 36787 and 36791, 36795 and 36799, 36803 and 36807 and 36811 and 36815 of the sequence listing. In these embodiments, the remainder of the heterodimeric antibody is XENCS559 from FIG. 50; that is, the VH from the CTLA-4 Fab is added N-terminally to the Fab Chain of XENCS559 and the VL from the CTLA-4 Fab is added N-terminally to the Light Chain of XENCS559.

In some embodiments, an anti-CTLA-4 Fab is selected from the pairs of SEQ ID NOs:36739 and 36743, 36747 and 36751, 36755 and 36759, 36763 and 36767, 36771 and 36775, 36779 and 36783, 36787 and 36791, 36795 and 36799, 36803 and 36807 and 36811 and 36815 of the sequence listing. In these embodiments, the remainder of the heterodimeric antibody is XENCS560 from FIG. 50; that is, the VH from the CTLA-4 Fab is added N-terminally to the Fab Chain of XENCS560 and the VL from the CTLA-4 Fab is added N-terminally to the Light Chain of XENCS560.

In some embodiments, an anti-CTLA-4 Fab is selected from the pairs of SEQ ID NOs:36739 and 36743, 36747 and 36751, 36755 and 36759, 36763 and 36767, 36771 and 36775, 36779 and 36783, 36787 and 36791, 36795 and 36799, 36803 and 36807 and 36811 and 36815 of the sequence listing. In these embodiments, the remainder of the heterodimeric antibody is XENCS561 from FIG. 50; that is, the VH from the CTLA-4 Fab is added N-terminally to the Fab Chain of XENCS561 and the VL from the CTLA-4 Fab is added N-terminally to the Light Chain of XENCS561.

In some embodiments, an anti-CTLA-4 Fab is selected from the pairs of SEQ ID NOs:36739 and 36743, 36747 and 36751, 36755 and 36759, 36763 and 36767, 36771 and 36775, 36779 and 36783, 36787 and 36791, 36795 and 36799, 36803 and 36807 and 36811 and 36815 of the sequence listing. In these embodiments, the remainder of the heterodimeric antibody is XENCS562 from FIG. 50; that is, the VH from the CTLA-4 Fab is added N-terminally to the Fab Chain of XENCS562 and the VL from the CTLA-4 Fab is added N-terminally to the Light Chain of XENCS562.

In some embodiments, an anti-CTLA-4 Fab is selected from the pairs of SEQ ID NOs:36739 and 36743, 36747 and 36751, 36755 and 36759, 36763 and 36767, 36771 and 36775, 36779 and 36783, 36787 and 36791, 36795 and 36799, 36803 and 36807 and 36811 and 36815 of the sequence listing. In these embodiments, the remainder of the heterodimeric antibody is XENCS563 from FIG. 50; that is, the VH from the CTLA-4 Fab is added N-terminally to the Fab Chain of XENCS563 and the VL from the CTLA-4 Fab is added N-terminally to the Light Chain of XENCS563.

In some embodiments, the PD-1 X CTLA-4 heterodimeric antibody of the invention is selected from the group consisting of XENCS502, XENCS509, XENCS516, XENCS523, XENCS530, XENCS537, XENCS544 and XENCS551.

B. PD-1 X ICOS Bottle Opener Embodiments

In some embodiments, the invention provides bispecific heterodimeric antibodies that bind to both human PD-1 and human ICOS. As will be appreciated by those in the art, there are a large number of possible combinations of anti-PD-1 scFv sequences with the ABDs for ICOS.

In some embodiments, the PD-1 ABD is the scFv and the ICOS ABD is the Fab construct. In these embodiments, any scFv ABD from FIG. 15A-15T can be combined with any anti-ICOS ABD sequence. Anti-ICOS sequences suitable for use as ABDs include many as disclosed in US2018/0127501, expressly incorporated by reference in its entirety and specifically for the legends and FIGS. 19, 20 and 24, the sequences depicted therein, as well as SEQ ID NOs:27869-28086 from US2018/0127501 which contain a number of ICOS Fab sequences (heavy chain VH1-CH1 and light chain VL1-CL) as indicated in the naming nomenclature. Additionally included are the anti-ICOS ABDs of the VH/VL pairs of SEQ ID NOs:26323 and 26328, 27477 and 27452 and 26353 and 26358 from the sequence listing from US2018/0127501. As will be understood from those in the art, these sequence identifiers come in "pairs" for the variable heavy and light chains, as will be apparent from the sequence identifiers.

Of particular interest in the present invention are the Fab sequences of the anti-ICOS ABD from XENCS500 in FIGS. 49A-49KK, with VH_ICOS_H0_L0 and VL_ICOS_H0_L0. Of particular interest in the present invention are the Fab sequences of the anti-ICOS ABD from XENCS501 in FIGS. 49A-49KK, with VH_ICOS_H0.66_L0 and VL_ICOS_H0.66_L0.

In some embodiments, the VH domain of the ICOS Fab is added to SEQ ID NO:471, the VL of the ICOS Fab is added to SEQ ID NO:473 and the PD-1 scFv is added to SEQ ID NO:472 of US2016/0355608. In some embodiments, the VH domain of the ICOS Fab is added to SEQ ID NO:474, the VL of the ICOS Fab is added to SEQ ID NO:476 and the PD-1 scFv is added to SEQ ID NO:475 of US2016/0355608. In some embodiments, the VH domain of the ICOS Fab is added to SEQ ID NO:477, the VL of the ICOS Fab is added to SEQ ID NO:479 and the PD-1 scFv is added to SEQ ID NO:478 of US2016/0355608. In some embodiments, the VH domain of the ICOS Fab is added to SEQ ID NO:480, the VL of the ICOS Fab is added to SEQ ID NO:482 and the PD-1 scFv is added to SEQ ID NO:481 of US2016/0355608.

In some embodiments, an anti-ICOS Fab is selected from VH/VL pairs of SEQ ID NOs:26323 and 26328, 27477 and 27452 and 26353 and 26358 from the sequence listing from US2018/0127501, with the Fab sequences of the anti-ICOS ABD from XENCS500 in FIGS. 49A-49KK (VH_ICOS_H0_L0 and VL_ICOS_H0_L0) and the anti-ICOS ABD from XENCS501 in FIGS. 49A-49KK (VH_ICOS_H0.66_L0 and VL_ICOS_H0.66_L0) finding particular use. In these embodiments, the remainder of the heterodimeric antibody is XENCS556 from FIG. 50; that is, the VH from the ICOS Fab is added N-terminally to the Fab Chain of XENCS556 and the VL from the ICOS Fab is added N-terminally to the Light Chain of XENCS556.

In some embodiments, an anti-ICOS Fab is selected from VH/VL pairs of SEQ ID NOs:26323 and 26328, 27477 and 27452 and 26353 and 26358 from the sequence listing from US2018/0127501, with the Fab sequences of the anti-ICOS ABD from XENCS500 in FIGS. 49A-49KK (VH_ICOS_H0_L0 and VL_ICOS_H0_L0) and the anti-ICOS ABD from XENCS501 in FIGS. 49A-49KK (VH_ICOS_H0.66_L0 and VL_ICOS_H0.66_L0) finding particular use. In these embodiments, the remainder of the heterodimeric antibody is XENCS557 from FIG. 50; that is, the VH from the ICOS Fab is added N-terminally to the Fab Chain of XENCS557 and the VL from the ICOS Fab is added N-terminally to the Light Chain of XENCS557.

In some embodiments, an anti-ICOS Fab is selected from VH/VL pairs of SEQ ID NOs:26323 and 26328, 27477 and 27452 and 26353 and 26358 from the sequence listing from US2018/0127501, with the Fab sequences of the anti-ICOS ABD from XENCS500 in FIGS. 49A-49KK (VH_ICOS_H0_L0 and VL_ICOS_H0_L0) and the anti-ICOS ABD from XENCS501 in FIGS. 49A-49KK (VH_ICOS_H0.66_L0 and VL_ICOS_H0.66_L0) finding particular use. In these embodiments, the remainder of the heterodimeric antibody is XENCS558 from FIG. 50; that is, the VH from the ICOS Fab is added N-terminally to the Fab Chain of XENCS558 and the VL from the ICOS Fab is added N-terminally to the Light Chain of XENCS558.

In some embodiments, an anti-ICOS Fab is selected from VH/VL pairs of SEQ ID NOs:26323 and 26328, 27477 and 27452 and 26353 and 26358 from the sequence listing from US2018/0127501, with the Fab sequences of the anti-ICOS ABD from XENCS500 in FIGS. 49A-49KK (VH_ICOS_H0_L0 and VL_ICOS_H0_L0) and the anti-ICOS ABD from XENCS501 in FIGS. 49A-49KK (VH_ICOS_H0.66_L0 and VL_ICOS_H0.66_L0) finding particular use. In these embodiments, the remainder of the heterodimeric antibody is XENCS559 from FIG. 50; that is, the VH from the ICOS Fab is added N-terminally to the Fab Chain of XENCS559 and the VL from the ICOS Fab is added N-terminally to the Light Chain of XENCS559.

In some embodiments, an anti-ICOS Fab is selected from VH/VL pairs of SEQ ID NOs:26323 and 26328, 27477 and 27452 and 26353 and 26358 from the sequence listing from US2018/0127501, with the Fab sequences of the anti-ICOS ABD from XENCS500 in FIGS. 49A-49KK (VH_ICOS_H0_L0 and VL_ICOS_H0_L0) and the anti-ICOS ABD from XENCS501 in FIGS. 49A-49KK (VH_ICOS_H0.66_L0 and VL_ICOS_H0.66_L0) finding particular use. In these embodiments, the remainder of the heterodimeric antibody is XENCS560 from FIG. 50; that is, the VH from the ICOS Fab is added N-terminally to the Fab Chain of XENCS560 and the VL from the ICOS Fab is added N-terminally to the Light Chain of XENCS560.

In some embodiments, an anti-ICOS Fab is selected from VH/VL pairs of SEQ ID NOs:26323 and 26328, 27477 and 27452 and 26353 and 26358 from the sequence listing from US2018/0127501, with the Fab sequences of the anti-ICOS ABD from XENCS500 in FIGS. 49A-49KK (VH_ICOS_H0_L0 and VL_ICOS_H0_L0) and the anti-ICOS ABD from XENCS501 in FIGS. 49A-49KK (VH_ICOS_H0.66_L0 and VL_ICOS_H0.66_L0) finding particular use. In these embodiments, the remainder of the heterodimeric antibody is XENCS561 from FIG. 50; that is, the VH from the ICOS Fab is added N-terminally to the Fab Chain of XENCS561 and the VL from the ICOS Fab is added N-terminally to the Light Chain of XENCS561.

In some embodiments, an anti-ICOS Fab is selected from VH/VL pairs of SEQ ID NOs:26323 and 26328, 27477 and 27452 and 26353 and 26358 from the sequence listing from US2018/0127501, with the Fab sequences of the anti-ICOS ABD from XENCS500 in FIGS. 49A-49KK (VH_ICOS_H0_L0 and VL_ICOS_H0_L0) and the anti-ICOS ABD from XENCS501 in FIGS. 49A-49KK (VH_ICOS_H0.66_L0 and VL_ICOS_H0.66_L0) finding particular use. In these embodiments, the remainder of the heterodimeric antibody is XENCS562 from FIG. 50; that is, the VH from the ICOS Fab is added N-terminally to the Fab Chain of XENCS562 and the VL from the ICOS Fab is added N-terminally to the Light Chain of XENCS562.

In some embodiments, an anti-ICOS Fab is selected from VH/VL pairs of SEQ ID NOs:26323 and 26328, 27477 and 27452 and 26353 and 26358 from the sequence listing from US2018/0127501, with the Fab sequences of the anti-ICOS ABD from XENCS500 in FIGS. 49A-49KK (VH_ICOS_H0_L0 and VL_ICOS_H0_L0) and the anti-ICOS ABD from XENCS501 in FIGS. 49A-49KK (VH_ICOS_H0.66_L0 and VL_ICOS_H0.66_L0) finding particular use. In these embodiments, the remainder of the heterodimeric antibody is XENCS563 from FIG. 50; that is, the VH from the ICOS Fab is added N-terminally to the Fab Chain of XENCS563 and the VL from the ICOS Fab is added N-terminally to the Light Chain of XENCS563.

In some embodiments, the PD-1 X ICOS heterodimeric antibody of the invention is selected from the group consisting of XENCS500, XENCS501, XENCS507, XENCS508, XENCS514, XENCS515, XENCS521, XENCS522, XENCS528, XENCS529, XENCS535, XENCS526, XENCS542, XENCS543, XENCS549 and XENCS550.

C. PD-1 X LAG-3 Bottle Opener Embodiments

In some embodiments, the invention provides bispecific heterodimeric antibodies that bind to both human PD-1 and human LAG-3. As will be appreciated by those in the art, there are a large number of possible combinations of anti-PD-1 scFv sequences with the ABDs for LAG-3.

In some embodiments, the PD-1 ABD is the scFv and the LAG-3 ABD is the Fab construct. In these embodiments, any scFv ABD from FIG. 15A-15T can be combined with any anti-LAG-3 ABD sequence. Anti-LAG-3 sequences suitable for use as ABDs include SEQ ID NOs: 17135-20764; SEQ ID NOs: 36819-36962; SEQ ID NOs: 35417-35606; SEQ ID NOs: 25194-32793; SEQ ID NOs: 32794-33002 (as will be understood from those in the art, all of these sequence identifiers come in "pairs" for the variable heavy and light chains, as will be apparent from the sequence identifiers); anti-LAG-3 Fabs selected the pairs of SEQ ID NOs:36819 and 36823, 36827 and 36831, 36835 and 36839, 36843 and 36847, 36851 and 36855, 36859 and 36863, 36867 and 36871, 36875 and 36879, 36883 and 36887, 36891 and 36895, 36899 and 36903, 36907 and 36911, 36915 and 36919, 36923 and 36927, 36931 and 36935, 36939 and 36943, 36947 and 36951 and 36955 and 36959; as well as the sequences of the LAG-3 Fab ABD of XENP22594, including the VH (SEQ ID NO:32755, with VHCDRs (SEQ ID NOs:32756, 32757 and 32758) and VL (SEQ ID NO:32760 with VLCDRs (SEQ ID NOs:32761, 32762 and 32763) and the sequences of the LAG-3 Fab ABD of XENP22656, including the VH (SEQ ID NO:28815, with VHCDRs (SEQ ID NOs:28816, 28817, and 28118) and VL (SEQ ID NO:28820, with VLCDRs (SEQ ID NOs:28821, 28822 and 28823).

In some embodiments, the VH domain of the LAG-3 Fab is added to SEQ ID NO:471, the VL of the LAG-3 Fab is added to SEQ ID NO:473 and the PD-1 scFv is added to SEQ ID NO:472 of US2016/0355608. In some embodiments, the VH domain of the LAG-3 Fab is added to SEQ ID NO:474, the VL of the LAG-3 Fab is added to SEQ ID NO:476 and the PD-1 scFv is added to SEQ ID NO:475 of US2016/0355608. In some embodiments, the VH domain of the LAG-3 Fab is added to SEQ ID NO:477, the VL of the LAG-3 Fab is added to SEQ ID NO:479 and the PD-1 scFv is added to SEQ ID NO:478 of US2016/0355608. In some embodiments, the VH domain of the LAG-3 Fab is added to SEQ ID NO:480, the VL of the LAG-3 Fab is added to SEQ ID NO:482 and the PD-1 scFv is added to SEQ ID NO:481 of US2016/0355608.

In some embodiments, the anti-LAG-3 Fab is selected from the pairs of SEQ ID NOs:36819 and 36823, 36827 and 36831, 36835 and 36839, 36843 and 36847, 36851 and 36855, 36859 and 36863, 36867 and 36871, 36875 and 36879, 36883 and 36887, 36891 and 36895, 36899 and 36903, 36907 and 36911, 36915 and 36919, 36923 and 36927, 36931 and 36935, 36939 and 36943, 36947 and 36951 and 36955 and 36959; with the VH/VL of XENP22594 (VH SEQ ID NO:32755 and VL SEQ ID NO:32760) and the VH/VL of XENP22656 (VH SEQ ID NO:28815 VL SEQ ID NO:28820) finding particular use.

In some embodiments, the anti-LAG-3 Fab is selected from the pairs of SEQ ID NOs:36819 and 36823, 36827 and 36831, 36835 and 36839, 36843 and 36847, 36851 and 36855, 36859 and 36863, 36867 and 36871, 36875 and 36879, 36883 and 36887, 36891 and 36895, 36899 and 36903, 36907 and 36911, 36915 and 36919, 36923 and 36927, 36931 and 36935, 36939 and 36943, 36947 and 36951 and 36955 and 36959; with the VH/VL of XENP22594 (VH SEQ ID NO:32755 and VL SEQ ID NO:32760) and the VH/VL of XENP22656 (VH SEQ ID NO:28815 VL SEQ ID NO:28820) finding particular use. In these embodiments, the remainder of the heterodimeric antibody is XENCS556 from FIG. 50; that is, the VH from the LAG-3 Fab is added N-terminally to the Fab Chain of XENCS556 and the VL from the LAG-3 Fab is added N-terminally to the Light Chain of XENCS556.

In some embodiments, the anti-LAG-3 Fab is selected from the pairs of SEQ ID NOs:36819 and 36823, 36827 and 36831, 36835 and 36839, 36843 and 36847, 36851 and 36855, 36859 and 36863, 36867 and 36871, 36875 and 36879, 36883 and 36887, 36891 and 36895, 36899 and 36903, 36907 and 36911, 36915 and 36919, 36923 and 36927, 36931 and 36935, 36939 and 36943, 36947 and 36951 and 36955 and 36959; with the VH/VL of XENP22594 (VH SEQ ID NO:32755 and VL SEQ ID NO:32760) and the VH/VL of XENP22656 (VH SEQ ID NO:28815 VL SEQ ID NO:28820) finding particular use. In these embodiments, the remainder of the heterodimeric antibody is XENCS557 from FIG. 50; that is, the VH from the LAG-3 Fab is added N-terminally to the Fab Chain of XENCS557 and the VL from the LAG-3 Fab is added N-terminally to the Light Chain of XENCS557.

In some embodiments, the anti-LAG-3 Fab is selected from the pairs of SEQ ID NOs:36819 and 36823, 36827 and 36831, 36835 and 36839, 36843 and 36847, 36851 and 36855, 36859 and 36863, 36867 and 36871, 36875 and 36879, 36883 and 36887, 36891 and 36895, 36899 and 36903, 36907 and 36911, 36915 and 36919, 36923 and 36927, 36931 and 36935, 36939 and 36943, 36947 and 36951 and 36955 and 36959; with the VH/VL of XENP22594 (VH SEQ ID NO:32755 and VL SEQ ID NO:32760) and the VH/VL of XENP22656 (VH SEQ ID NO:28815 VL SEQ ID NO:28820) finding particular use. In these embodiments, the remainder of the heterodimeric antibody is XENCS558 from FIG. 50; that is, the VH from the LAG-3 Fab is added N-terminally to the Fab Chain of XENCS558 and the VL from the LAG-3 Fab is added N-terminally to the Light Chain of XENCS558.

In some embodiments, the anti-LAG-3 Fab is selected from the pairs of SEQ ID NOs:36819 and 36823, 36827 and 36831, 36835 and 36839, 36843 and 36847, 36851 and 36855, 36859 and 36863, 36867 and 36871, 36875 and 36879, 36883 and 36887, 36891 and 36895, 36899 and 36903, 36907 and 36911, 36915 and 36919, 36923 and 36927, 36931 and 36935, 36939 and 36943, 36947 and 36951 and 36955 and 36959; with the VH/VL of XENP22594 (VH SEQ ID NO:32755 and VL SEQ ID NO:32760) and the VH/VL of XENP22656 (VH SEQ ID NO:28815 VL SEQ ID NO:28820) finding particular use. In these embodiments, the remainder of the heterodimeric antibody is XENCS559 from FIG. 50; that is, the VH from the LAG-3 Fab is added N-terminally to the Fab Chain of XENCS559 and the VL from the LAG-3 Fab is added N-terminally to the Light Chain of XENCS559.

In some embodiments, the anti-LAG-3 Fab is selected from the pairs of SEQ ID NOs:36819 and 36823, 36827 and 36831, 36835 and 36839, 36843 and 36847, 36851 and 36855, 36859 and 36863, 36867 and 36871, 36875 and 36879, 36883 and 36887, 36891 and 36895, 36899 and 36903, 36907 and 36911, 36915 and 36919, 36923 and 36927, 36931 and 36935, 36939 and 36943, 36947 and 36951 and 36955 and 36959; with the VH/VL of XENP22594 (VH SEQ ID NO:32755 and VL SEQ ID NO:32760) and the VH/VL of XENP22656 (VH SEQ ID NO:28815 VL SEQ ID NO:28820) finding particular use. In these embodiments, the remainder of the heterodimeric antibody is XENCS560 from FIG. 50; that is, the VH from the LAG-3 Fab is added N-terminally to the Fab Chain of XENCS560 and the VL from the LAG-3 Fab is added N-terminally to the Light Chain of XENCS560.

In some embodiments, the anti-LAG-3 Fab is selected from the pairs of SEQ ID NOs:36819 and 36823, 36827 and 36831, 36835 and 36839, 36843 and 36847, 36851 and 36855, 36859 and 36863, 36867 and 36871, 36875 and 36879, 36883 and 36887, 36891 and 36895, 36899 and 36903, 36907 and 36911, 36915 and 36919, 36923 and 36927, 36931 and 36935, 36939 and 36943, 36947 and 36951 and 36955 and 36959; with the VH/VL of XENP22594 (VH SEQ ID NO:32755 and VL SEQ ID NO:32760) and the VH/VL of XENP22656 (VH SEQ ID NO:28815 VL SEQ ID NO:28820) finding particular use. In these embodiments, the remainder of the heterodimeric antibody is XENCS561 from FIG. 50; that is, the VH from the LAG-3 Fab is added N-terminally to the Fab Chain of XENCS561 and the VL from the LAG-3 Fab is added N-terminally to the Light Chain of XENCS561.

In some embodiments, the anti-LAG-3 Fab is selected from the pairs of SEQ ID NOs:36819 and 36823, 36827 and 36831, 36835 and 36839, 36843 and 36847, 36851 and 36855, 36859 and 36863, 36867 and 36871, 36875 and 36879, 36883 and 36887, 36891 and 36895, 36899 and 36903, 36907 and 36911, 36915 and 36919, 36923 and 36927, 36931 and 36935, 36939 and 36943, 36947 and 36951 and 36955 and 36959; with the VH/VL of XENP22594 (VH SEQ ID NO:32755 and VL SEQ ID NO:32760) and the VH/VL of XENP22656 (VH SEQ ID NO:28815 VL SEQ ID NO:28820) finding particular use. In these embodiments, the remainder of the heterodimeric antibody is XENCS562 from FIG. 50; that is, the VH from the LAG-3 Fab is added N-terminally to the Fab Chain of XENCS562 and the VL from the LAG-3 Fab is added N-terminally to the Light Chain of XENCS562.

In some embodiments, the anti-LAG-3 Fab is selected from the pairs of SEQ ID NOs:36819 and 36823, 36827 and 36831, 36835 and 36839, 36843 and 36847, 36851 and 36855, 36859 and 36863, 36867 and 36871, 36875 and 36879, 36883 and 36887, 36891 and 36895, 36899 and 36903, 36907 and 36911, 36915 and 36919, 36923 and 36927, 36931 and 36935, 36939 and 36943, 36947 and 36951 and 36955 and 36959; with the VH/VL of XENP22594 (VH SEQ ID NO:32755 and VL SEQ ID NO:32760) and the VH/VL of XENP22656 (VH SEQ ID NO:28815 VL SEQ ID NO:28820) finding particular use. In these embodiments, the remainder of the heterodimeric antibody is XENCS563 from FIG. 50; that is, the VH from the LAG-3 Fab is added N-terminally to the Fab Chain of XENCS563 and the VL from the LAG-3 Fab is added N-terminally to the Light Chain of XENCS563.

In some embodiments, the PD-1 X LAG-3 heterodimeric antibody of the invention is selected from the group consisting of XENCS503, XENCS504, XENCS510, XENCS511, XENCS517, XENCS518, XENCS521, XENCS524, XENCS525, XENCS531, XENCS532, XENCS538, XENCS539, XENCS545, XENCS546, XENCS552 and XENCS553.

D. PD-1 X TIM-3 Bottle Opener Embodiments

In some embodiments, the invention provides bispecific heterodimeric antibodies that bind to both human PD-1 and human TIM-3. As will be appreciated by those in the art, there are a large number of possible combinations of anti-PD-1 scFv sequences with the ABDs for TIM-3.

In some embodiments, the PD-1 ABD is the scFv and the TIM-3 ABD is the Fab construct. In these embodiments, any scFv ABD from FIG. 15A-15T can be combined with any anti-TIM-3 ABD sequence. Anti-TIM-3 sequences suitable for use as ABDs include SEQ ID NOs: 20765-20884; SEQ ID NOs: 37587-37698; SEQ ID NOs: 36347-36706 (as will be understood from those in the art, these sequence identifiers come in "pairs" for the variable heavy and light chains, as will be apparent from the sequence identifiers), anti-TIM-3 ABDs selected from the pairs of SEQ ID NOs:35757 and 37591, 37959 and 37599, 37603 and 37607, 37611 and 37615, 37619 and 37623, 37627 and 37631, 37635 and 37639, 37643 and 37647, 37651 and 37655, 37659 and 37663, 37667 and 37671, 37675 and 37679, 37683 and 37687 and 37691 and 37695; as well as the Fab sequences of the anti-TIM-3 ABD of XENP21189 (VH SEQ ID NO:36508 and VL SEQ ID NO:36513) finding particular use.

In some embodiments, the VH domain of the TIM-3 Fab is added to SEQ ID NO:471, the VL of the TIM-3 Fab is added to SEQ ID NO:473 and the PD-1 scFv is added to SEQ ID NO:472 of US2016/0355608. In some embodiments, the VH domain of the TIM-3 Fab is added to SEQ ID NO:474, the VL of the TIM-3 Fab is added to SEQ ID NO:476 and the PD-1 scFv is added to SEQ ID NO:475 of US2016/0355608. In some embodiments, the VH domain of the TIM-3 Fab is added to SEQ ID NO:477, the VL of the TIM-3 Fab is added to SEQ ID NO:479 and the PD-1 scFv is added to SEQ ID NO:478 of US2016/0355608. In some embodiments, the VH domain of the TIM-3 Fab is added to SEQ ID NO:480, the VL of the TIM-3 Fab is added to SEQ ID NO:482 and the PD-1 scFv is added to SEQ ID NO:481 of US2016/0355608.

Anti-TIM-3 sequences suitable for use as ABDs include SEQ ID NOs: 20765-20884; SEQ ID NOs: 37587-37698; SEQ ID NOs: 36347-36706 (as will be understood from those in the art, these sequence identifiers come in "pairs" for the variable heavy and light chains, as will be apparent from the sequence identifiers), anti-TIM-3 ABDs selected from the pairs of SEQ ID NOs:35757 and 37591, 37959 and 37599, 37603 and 37607, 37611 and 37615, 37619 and 37623, 37627 and 37631, 37635 and 37639, 37643 and 37647, 37651 and 37655, 37659 and 37663, 37667 and 37671, 37675 and 37679, 37683 and 37687 and 37691 and 37695; as well as the Fab sequences of the anti-TIM-3 ABD of XENP21189 (VH SEQ ID NO:36508 and VL SEQ ID NO:36513) finding particular use. In these embodiments, the remainder of the heterodimeric antibody is XENCS556 from FIG. 50; that is, the VH from the TIM-3 Fab is added N-terminally to the Fab Chain of XENCS556 and the VL from the TIM-3 Fab is added N-terminally to the Light Chain of XENCS556.

Anti-TIM-3 sequences suitable for use as ABDs include SEQ ID NOs: 20765-20884; SEQ ID NOs: 37587-37698; SEQ ID NOs: 36347-36706 (as will be understood from those in the art, these sequence identifiers come in "pairs" for the variable heavy and light chains, as will be apparent from the sequence identifiers), anti-TIM-3 ABDs selected from the pairs of SEQ ID NOs:35757 and 37591, 37959 and 37599, 37603 and 37607, 37611 and 37615, 37619 and 37623, 37627 and 37631, 37635 and 37639, 37643 and 37647, 37651 and 37655, 37659 and 37663, 37667 and 37671, 37675 and 37679, 37683 and 37687 and 37691 and 37695; as well as the Fab sequences of the anti-TIM-3 ABD of XENP21189 (VH SEQ ID NO:36508 and VL SEQ ID NO:36513) finding particular use. In these embodiments, the remainder of the heterodimeric antibody is XENCS557 from FIG. 50; that is, the VH from the TIM-3 Fab is added N-terminally to the Fab Chain of XENCS557 and the VL from the TIM-3 Fab is added N-terminally to the Light Chain of XENCS557.

Anti-TIM-3 sequences suitable for use as ABDs include SEQ ID NOs: 20765-20884; SEQ ID NOs: 37587-37698; SEQ ID NOs: 36347-36706 (as will be understood from those in the art, these sequence identifiers come in "pairs" for the variable heavy and light chains, as will be apparent from the sequence identifiers), anti-TIM-3 ABDs selected from the pairs of SEQ ID NOs:35757 and 37591, 37959 and 37599, 37603 and 37607, 37611 and 37615, 37619 and 37623, 37627 and 37631, 37635 and 37639, 37643 and 37647, 37651 and 37655, 37659 and 37663, 37667 and 37671, 37675 and 37679, 37683 and 37687 and 37691 and 37695; as well as the Fab sequences of the anti-TIM-3 ABD of XENP21189 (VH SEQ ID NO:36508 and VL SEQ ID NO:36513) finding particular use. In these embodiments, the remainder of the heterodimeric antibody is XENCS558 from FIG. 50; that is, the VH from the TIM-3 Fab is added N-terminally to the Fab Chain of XENCS558 and the VL from the TIM-3 Fab is added N-terminally to the Light Chain of XENCS558.

Anti-TIM-3 sequences suitable for use as ABDs include SEQ ID NOs: 20765-20884; SEQ ID NOs: 37587-37698; SEQ ID NOs: 36347-36706 (as will be understood from those in the art, these sequence identifiers come in "pairs" for the variable heavy and light chains, as will be apparent from the sequence identifiers), anti-TIM-3 ABDs selected from the pairs of SEQ ID NOs:35757 and 37591, 37959 and 37599, 37603 and 37607, 37611 and 37615, 37619 and 37623, 37627 and 37631, 37635 and 37639, 37643 and 37647, 37651 and 37655, 37659 and 37663, 37667 and 37671, 37675 and 37679, 37683 and 37687 and 37691 and 37695; as well as the Fab sequences of the anti-TIM-3 ABD of XENP21189 (VH SEQ ID NO:36508 and VL SEQ ID NO:36513) finding particular use. In these embodiments, the remainder of the heterodimeric antibody is XENCS559 from FIG. 50; that is, the VH from the TIM-3 Fab is added N-terminally to the Fab Chain of XENCS559 and the VL from the TIM-3 Fab is added N-terminally to the Light Chain of XENCS559.

Anti-TIM-3 sequences suitable for use as ABDs include SEQ ID NOs: 20765-20884; SEQ ID NOs: 37587-37698; SEQ ID NOs: 36347-36706 (as will be understood from those in the art, these sequence identifiers come in "pairs" for the variable heavy and light chains, as will be apparent from the sequence identifiers), anti-TIM-3 ABDs selected from the pairs of SEQ ID NOs:35757 and 37591, 37959 and 37599, 37603 and 37607, 37611 and 37615, 37619 and 37623, 37627 and 37631, 37635 and 37639, 37643 and 37647, 37651 and 37655, 37659 and 37663, 37667 and 37671, 37675 and 37679, 37683 and 37687 and 37691 and 37695; as well as the Fab sequences of the anti-TIM-3 ABD of XENP21189 (VH SEQ ID NO:36508 and VL SEQ ID NO:36513) finding particular use. In these embodiments, the remainder of the heterodimeric antibody is XENCS560 from FIG. 50; that is, the VH from the TIM-3 Fab is added N-terminally to the Fab Chain of XENCS560 and the VL from the TIM-3 Fab is added N-terminally to the Light Chain of XENCS560.

Anti-TIM-3 sequences suitable for use as ABDs include SEQ ID NOs: 20765-20884; SEQ ID NOs: 37587-37698; SEQ ID NOs: 36347-36706 (as will be understood from those in the art, these sequence identifiers come in "pairs" for the variable heavy and light chains, as will be apparent from the sequence identifiers), anti-TIM-3 ABDs selected from the pairs of SEQ ID NOs:35757 and 37591, 37959 and 37599, 37603 and 37607, 37611 and 37615, 37619 and 37623, 37627 and 37631, 37635 and 37639, 37643 and 37647, 37651 and 37655, 37659 and 37663, 37667 and 37671, 37675 and 37679, 37683 and 37687 and 37691 and 37695; as well as the Fab sequences of the anti-TIM-3 ABD of XENP21189 (VH SEQ ID NO:36508 and VL SEQ ID NO:36513) finding particular use. In these embodiments, the remainder of the heterodimeric antibody is XENCS561 from FIG. 50; that is, the VH from the TIM-3 Fab is added N-terminally to the Fab Chain of XENCS561 and the VL from the TIM-3 Fab is added N-terminally to the Light Chain of XENCS561.

Anti-TIM-3 sequences suitable for use as ABDs include SEQ ID NOs: 20765-20884; SEQ ID NOs: 37587-37698; SEQ ID NOs: 36347-36706 (as will be understood from those in the art, these sequence identifiers come in "pairs" for the variable heavy and light chains, as will be apparent from the sequence identifiers), anti-TIM-3 ABDs selected from the pairs of SEQ ID NOs:35757 and 37591, 37959 and 37599, 37603 and 37607, 37611 and 37615, 37619 and 37623, 37627 and 37631, 37635 and 37639, 37643 and 37647, 37651 and 37655, 37659 and 37663, 37667 and 37671, 37675 and 37679, 37683 and 37687 and 37691 and 37695; as well as the Fab sequences of the anti-TIM-3 ABD of XENP21189 (VH SEQ ID NO:36508 and VL SEQ ID NO:36513) finding particular use. In these embodiments, the remainder of the heterodimeric antibody is XENCS562 from FIG. 50; that is, the VH from the TIM-3 Fab is added N-terminally to the Fab Chain of XENCS562 and the VL from the TIM-3 Fab is added N-terminally to the Light Chain of XENCS562.

Anti-TIM-3 sequences suitable for use as ABDs include SEQ ID NOs: 20765-20884; SEQ ID NOs: 37587-37698; SEQ ID NOs: 36347-36706 (as will be understood from those in the art, these sequence identifiers come in "pairs" for the variable heavy and light chains, as will be apparent from the sequence identifiers), anti-TIM-3 ABDs selected from the pairs of SEQ ID NOs:35757 and 37591, 37959 and 37599, 37603 and 37607, 37611 and 37615, 37619 and 37623, 37627 and 37631, 37635 and 37639, 37643 and 37647, 37651 and 37655, 37659 and 37663, 37667 and 37671, 37675 and 37679, 37683 and 37687 and 37691 and 37695; as well as the Fab sequences of the anti-TIM-3 ABD of XENP21189 (VH SEQ ID NO:36508 and VL SEQ ID NO:36513) finding particular use. In these embodiments, the remainder of the heterodimeric antibody is XENCS563 from FIG. 50; that is, the VH from the TIM-3 Fab is added N-terminally to the Fab Chain of XENCS563 and the VL from the TIM-3 Fab is added N-terminally to the Light Chain of XENCS563.

In some embodiments, the PD-1 X TIM-3 heterodimeric antibody of the invention is selected from the group consisting of XENCS505, XENCS512, XENCS519, XENCS526, XENCS533, XENCS540, XENCS547 and XENCS554.

E. PD-1 X TIGIT Bottle Opener Embodiments

In some embodiments, the invention provides bispecific heterodimeric antibodies that bind to both human PD-1 and human TIGIT. As will be appreciated by those in the art, there are a large number of possible combinations of anti-PD-1 scFv sequences with the ABDs for TIGIT.

In some embodiments, the PD-1 ABD is the scFv and the TIGIT ABD is the Fab construct. In these embodiments, any scFv ABD from FIG. 15A-15T can be combined with any anti-TIGIT ABD sequence. Anti-TIGIT sequences suitable for use as ABDs include SEQ ID NOs: 21504-21523 and SEQ ID NOs: 37435-37586 (as will be understood from those in the art, these sequence identifiers come in "pairs" for the variable heavy and light chains, as will be apparent from the sequence identifiers), as well as TIGIT ABDs selected from the pairs of SEQ ID NOs:37435 and 37439, 37443 and 37447, 37451 and 37455, 37459 and 37463, 37467 and 37471, 37475 and 37479, 37483 and 37487, 37491 and 37495, 37499 and 37503, 37507 and 37511, 37515 and 37519, 37523 and 37527, 37531 and 37535, 37539 and 37543, 37547 and 37551, 37555 and 37559, 37563 and 37567, 37571 and 37575 and 37579 and 37583.

In some embodiments, the VH domain of the TIGIT Fab is added to SEQ ID NO:471, the VL of the TIGIT Fab is added to SEQ ID NO:473 and the PD-1 scFv is added to SEQ ID NO:472 of US2016/0355608. In some embodiments, the VH domain of the TIGIT Fab is added to SEQ ID NO:474, the VL of the TIGIT Fab is added to SEQ ID NO:476 and the PD-1 scFv is added to SEQ ID NO:475 of US2016/0355608. In some embodiments, the VH domain of the TIGIT Fab is added to SEQ ID NO:477, the VL of the TIGIT Fab is added to SEQ ID NO:479 and the PD-1 scFv is added to SEQ ID NO:478 of US2016/0355608. In some embodiments, the VH domain of the TIGIT Fab is added to SEQ ID NO:480, the VL of the TIGIT Fab is added to SEQ ID NO:482 and the PD-1 scFv is added to SEQ ID NO:481 of US2016/0355608.

Anti-TIGIT sequences suitable for use as ABDs include SEQ ID NOs: 21504-21523 and SEQ ID NOs: 37435-37586 (as will be understood from those in the art, these sequence identifiers come in "pairs" for the variable heavy and light chains, as will be apparent from the sequence identifiers), as well as TIGIT ABDs selected from the pairs of SEQ ID NOs:37435 and 37439, 37443 and 37447, 37451 and 37455, 37459 and 37463, 37467 and 37471, 37475 and 37479, 37483 and 37487, 37491 and 37495, 37499 and 37503, 37507 and 37511, 37515 and 37519, 37523 and 37527, 37531 and 37535, 37539 and 37543, 37547 and 37551, 37555 and 37559, 37563 and 37567, 37571 and 37575 and 37579 and 37583. In these embodiments, the remainder of the heterodimeric antibody is XENCS556 from FIG. 50; that is, the VH from the TIGIT Fab is added N-terminally to the Fab Chain of XENCS556 and the VL from the TIGIT Fab is added N-terminally to the Light Chain of XENCS556.

Anti-TIGIT sequences suitable for use as ABDs include SEQ ID NOs: 21504-21523 and SEQ ID NOs: 37435-37586 (as will be understood from those in the art, these sequence identifiers come in "pairs" for the variable heavy and light chains, as will be apparent from the sequence identifiers), as well as TIGIT ABDs selected from the pairs of SEQ ID NOs:37435 and 37439, 37443 and 37447, 37451 and 37455, 37459 and 37463, 37467 and 37471, 37475 and 37479, 37483 and 37487, 37491 and 37495, 37499 and 37503, 37507 and 37511, 37515 and 37519, 37523 and 37527, 37531 and 37535, 37539 and 37543, 37547 and 37551, 37555 and 37559, 37563 and 37567, 37571 and 37575 and 37579 and 37583. In these embodiments, the remainder of the heterodimeric antibody is XENCS557 from FIG. 50; that is, the VH from the TIGIT Fab is added N-terminally to the Fab Chain of XENCS557 and the VL from the TIGIT Fab is added N-terminally to the Light Chain of XENCS557.

Anti-TIGIT sequences suitable for use as ABDs include SEQ ID NOs: 21504-21523 and SEQ ID NOs: 37435-37586 (as will be understood from those in the art, these sequence identifiers come in "pairs" for the variable heavy and light chains, as will be apparent from the sequence identifiers), as well as TIGIT ABDs selected from the pairs of SEQ ID NOs:37435 and 37439, 37443 and 37447, 37451 and 37455, 37459 and 37463, 37467 and 37471, 37475 and 37479, 37483 and 37487, 37491 and 37495, 37499 and 37503, 37507 and 37511, 37515 and 37519, 37523 and 37527, 37531 and 37535, 37539 and 37543, 37547 and 37551, 37555 and 37559, 37563 and 37567, 37571 and 37575 and 37579 and 37583. In these embodiments, the remainder of the heterodimeric antibody is XENCS558 from FIG. 50; that is, the VH from the TIGIT Fab is added N-terminally to the Fab Chain of XENCS558 and the VL from the TIGIT Fab is added N-terminally to the Light Chain of XENCS558.

Anti-TIGIT sequences suitable for use as ABDs include SEQ ID NOs: 21504-21523 and SEQ ID NOs: 37435-37586 (as will be understood from those in the art, these sequence identifiers come in "pairs" for the variable heavy and light chains, as will be apparent from the sequence identifiers), as well as TIGIT ABDs selected from the pairs of SEQ ID NOs:37435 and 37439, 37443 and 37447, 37451 and 37455, 37459 and 37463, 37467 and 37471, 37475 and 37479, 37483 and 37487, 37491 and 37495, 37499 and 37503, 37507 and 37511, 37515 and 37519, 37523 and 37527, 37531 and 37535, 37539 and 37543, 37547 and 37551, 37555 and 37559, 37563 and 37567, 37571 and 37575 and 37579 and 37583. In these embodiments, the remainder of the heterodimeric antibody is XENCS559 from FIG. 50; that is, the VH from the TIGIT Fab is added N-terminally to the Fab Chain of XENCS559 and the VL from the TIGIT Fab is added N-terminally to the Light Chain of XENCS559.

Anti-TIGIT sequences suitable for use as ABDs include SEQ ID NOs: 21504-21523 and SEQ ID NOs: 37435-37586 (as will be understood from those in the art, these sequence identifiers come in "pairs" for the variable heavy and light chains, as will be apparent from the sequence identifiers), as well as TIGIT ABDs selected from the pairs of SEQ ID NOs:37435 and 37439, 37443 and 37447, 37451 and 37455, 37459 and 37463, 37467 and 37471, 37475 and 37479, 37483 and 37487, 37491 and 37495, 37499 and 37503, 37507 and 37511, 37515 and 37519, 37523 and 37527, 37531 and 37535, 37539 and 37543, 37547 and 37551, 37555 and 37559, 37563 and 37567, 37571 and 37575 and 37579 and 37583. In these embodiments, the remainder of the heterodimeric antibody is XENCS560 from FIG. 50; that is, the VH from the TIGIT Fab is added N-terminally to the Fab Chain of XENCS560 and the VL from the TIGIT Fab is added N-terminally to the Light Chain of XENCS560.

Anti-TIGIT sequences suitable for use as ABDs include SEQ ID NOs: 21504-21523 and SEQ ID NOs: 37435-37586 (as will be understood from those in the art, these sequence identifiers come in "pairs" for the variable heavy and light chains, as will be apparent from the sequence identifiers), as well as TIGIT ABDs selected from the pairs of SEQ ID NOs:37435 and 37439, 37443 and 37447, 37451 and 37455, 37459 and 37463, 37467 and 37471, 37475 and 37479, 37483 and 37487, 37491 and 37495, 37499 and 37503, 37507 and 37511, 37515 and 37519, 37523 and 37527, 37531 and 37535, 37539 and 37543, 37547 and 37551, 37555 and 37559, 37563 and 37567, 37571 and 37575 and 37579 and 37583. In these embodiments, the remainder of the heterodimeric antibody is XENCS561 from FIG. 50; that is, the VH from the TIGIT Fab is added N-terminally to the Fab Chain of XENCS561 and the VL from the TIGIT Fab is added N-terminally to the Light Chain of XENCS561.

Anti-TIGIT sequences suitable for use as ABDs include SEQ ID NOs: 21504-21523 and SEQ ID NOs: 37435-37586 (as will be understood from those in the art, these sequence identifiers come in "pairs" for the variable heavy and light chains, as will be apparent from the sequence identifiers), as well as TIGIT ABDs selected from the pairs of SEQ ID NOs:37435 and 37439, 37443 and 37447, 37451 and 37455, 37459 and 37463, 37467 and 37471, 37475 and 37479, 37483 and 37487, 37491 and 37495, 37499 and 37503, 37507 and 37511, 37515 and 37519, 37523 and 37527, 37531 and 37535, 37539 and 37543, 37547 and 37551, 37555 and 37559, 37563 and 37567, 37571 and 37575 and 37579 and 37583. In these embodiments, the remainder of the heterodimeric antibody is XENCS562 from FIG. 50; that is, the VH from the TIGIT Fab is added N-terminally to the Fab Chain of XENCS562 and the VL from the TIGIT Fab is added N-terminally to the Light Chain of XENCS562.

Anti-TIGIT sequences suitable for use as ABDs include SEQ ID NOs: 21504-21523 and SEQ ID NOs: 37435-37586 (as will be understood from those in the art, these sequence identifiers come in "pairs" for the variable heavy and light chains, as will be apparent from the sequence identifiers), as well as TIGIT ABDs selected from the pairs of SEQ ID NOs:37435 and 37439, 37443 and 37447, 37451 and 37455, 37459 and 37463, 37467 and 37471, 37475 and 37479, 37483 and 37487, 37491 and 37495, 37499 and 37503, 37507 and 37511, 37515 and 37519, 37523 and 37527, 37531 and 37535, 37539 and 37543, 37547 and 37551, 37555 and 37559, 37563 and 37567, 37571 and 37575 and 37579 and 37583. In these embodiments, the remainder of the heterodimeric antibody is XENCS563 from FIG. 50; that is, the VH from the TIGIT Fab is added N-terminally to the Fab Chain of XENCS563 and the VL from the TIGIT Fab is added N-terminally to the Light Chain of XENCS563.

F. PD-1 X BTLA Bottle Opener Embodiments

In some embodiments, the PD-1 ABD is the scFv and the BTLA ABD is the Fab construct. In these embodiments, any scFv ABD from FIG. 15A-15T can be combined with any anti-BTLA ABD sequence Anti-BTLA sequences suitable for use as ABDs include SEQ ID NOs: 20885-21503 and SEQ ID NOs: 36707-36738 (s will be understood from those in the art, these sequence identifiers come in "pairs" for the variable heavy and light chains, as will be apparent from the sequence identifiers); anti-BTLA ABD selected from the pairs of SEQ ID NOs:36707 and 36711, 36715 and 36719, 36723 and 36727 and 36761 and 36735; with the Fab anti-BTLA ABD of XENP20269 (VH SEQ ID NO:20936 and VL SEQ ID NO:20941) finding particular use.

In some embodiments, the VH domain of the BTLA Fab is added to SEQ ID NO:471, the VL of the BTLA Fab is added to SEQ ID NO:473 and the PD-1 scFv is added to SEQ ID NO:472 of US2016/0355608. In some embodiments, the VH domain of the BTLA Fab is added to SEQ ID NO:474, the VL of the BTLA Fab is added to SEQ ID NO:476 and the PD-1 scFv is added to SEQ ID NO:475 of US2016/0355608. In some embodiments, the VH domain of the BTLA Fab is added to SEQ ID NO:477, the VL of the BTLA Fab is added to SEQ ID NO:479 and the PD-1 scFv is added to SEQ ID NO:478 of US2016/0355608. In some embodiments, the VH domain of the BTLA Fab is added to SEQ ID NO:480, the VL of the BTLA Fab is added to SEQ ID NO:482 and the PD-1 scFv is added to SEQ ID NO:481 of US2016/0355608.

Anti-BTLA sequences suitable for use as ABDs include SEQ ID NOs: 20885-21503 and SEQ ID NOs: 36707-36738 (s will be understood from those in the art, these sequence identifiers come in "pairs" for the variable heavy and light chains, as will be apparent from the sequence identifiers); anti-BTLA ABD selected from the pairs of SEQ ID NOs: 36707 and 36711, 36715 and 36719, 36723 and 36727 and 36761 and 36735; with the Fab anti-BTLA ABD of XENP20269 (VH SEQ ID NO:20936 and VL SEQ ID NO:20941) finding particular use. In these embodiments, the remainder of the heterodimeric antibody is XENCS556 from FIG. 50; that is, the VH from the BTLA Fab is added N-terminally to the Fab Chain of XENCS556 and the VL from the BTLA Fab is added N-terminally to the Light Chain of XENCS556.

Anti-BTLA sequences suitable for use as ABDs include SEQ ID NOs: 20885-21503 and SEQ ID NOs: 36707-36738 (s will be understood from those in the art, these sequence identifiers come in "pairs" for the variable heavy and light chains, as will be apparent from the sequence identifiers); anti-BTLA ABD selected from the pairs of SEQ ID NOs: 36707 and 36711, 36715 and 36719, 36723 and 36727 and 36761 and 36735; with the Fab anti-BTLA ABD of XENP20269 (VH SEQ ID NO:20936 and VL SEQ ID NO:20941) finding particular use. In these embodiments, the remainder of the heterodimeric antibody is XENCS557 from FIG. 50; that is, the VH from the BTLA Fab is added N-terminally to the Fab Chain of XENCS557 and the VL from the BTLA Fab is added N-terminally to the Light Chain of XENCS557.

Anti-BTLA sequences suitable for use as ABDs include SEQ ID NOs: 20885-21503 and SEQ ID NOs: 36707-36738 (s will be understood from those in the art, these sequence identifiers come in "pairs" for the variable heavy and light chains, as will be apparent from the sequence identifiers); anti-BTLA ABD selected from the pairs of SEQ ID NOs: 36707 and 36711, 36715 and 36719, 36723 and 36727 and 36761 and 36735; with the Fab anti-BTLA ABD of XENP20269 (VH SEQ ID NO:20936 and VL SEQ ID NO:20941) finding particular use. In these embodiments, the remainder of the heterodimeric antibody is XENCS558 from FIG. 50; that is, the VH from the BTLA Fab is added N-terminally to the Fab Chain of XENCS558 and the VL from the BTLA Fab is added N-terminally to the Light Chain of XENCS558.

Anti-BTLA sequences suitable for use as ABDs include SEQ ID NOs: 20885-21503 and SEQ ID NOs: 36707-36738 (s will be understood from those in the art, these sequence identifiers come in "pairs" for the variable heavy and light chains, as will be apparent from the sequence identifiers); anti-BTLA ABD selected from the pairs of SEQ ID NOs: 36707 and 36711, 36715 and 36719, 36723 and 36727 and 36761 and 36735; with the Fab anti-BTLA ABD of XENP20269 (VH SEQ ID NO:20936 and VL SEQ ID NO:20941) finding particular use. In these embodiments, the remainder of the heterodimeric antibody is XENCS559 from FIG. 50; that is, the VH from the BTLA Fab is added N-terminally to the Fab Chain of XENCS559 and the VL from the BTLA Fab is added N-terminally to the Light Chain of XENCS559.

Anti-BTLA sequences suitable for use as ABDs include SEQ ID NOs: 20885-21503 and SEQ ID NOs: 36707-36738 (s will be understood from those in the art, these sequence identifiers come in "pairs" for the variable heavy and light chains, as will be apparent from the sequence identifiers); anti-BTLA ABD selected from the pairs of SEQ ID NOs: 36707 and 36711, 36715 and 36719, 36723 and 36727 and 36761 and 36735; with the Fab anti-BTLA ABD of XENP20269 (VH SEQ ID NO:20936 and VL SEQ ID NO:20941) finding particular use. In these embodiments, the remainder of the heterodimeric antibody is XENCS560 from FIG. 50; that is, the VH from the BTLA Fab is added N-terminally to the Fab Chain of XENCS560 and the VL from the BTLA Fab is added N-terminally to the Light Chain of XENCS560.

Anti-BTLA sequences suitable for use as ABDs include SEQ ID NOs: 20885-21503 and SEQ ID NOs: 36707-36738 (s will be understood from those in the art, these sequence identifiers come in "pairs" for the variable heavy and light chains, as will be apparent from the sequence identifiers); anti-BTLA ABD selected from the pairs of SEQ ID NOs: 36707 and 36711, 36715 and 36719, 36723 and 36727 and 36761 and 36735; with the Fab anti-BTLA ABD of XENP20269 (VH SEQ ID NO:20936 and VL SEQ ID NO:20941) finding particular use. In these embodiments, the remainder of the heterodimeric antibody is XENCS561 from FIG. 50; that is, the VH from the BTLA Fab is added N-terminally to the Fab Chain of XENCS561 and the VL from the BTLA Fab is added N-terminally to the Light Chain of XENCS561.

Anti-BTLA sequences suitable for use as ABDs include SEQ ID NOs: 20885-21503 and SEQ ID NOs: 36707-36738 (s will be understood from those in the art, these sequence identifiers come in "pairs" for the variable heavy and light chains, as will be apparent from the sequence identifiers); anti-BTLA ABD selected from the pairs of SEQ ID NOs: 36707 and 36711, 36715 and 36719, 36723 and 36727 and 36761 and 36735; with the Fab anti-BTLA ABD of XENP20269 (VH SEQ ID NO:20936 and VL SEQ ID NO:20941) finding particular use. In these embodiments, the remainder of the heterodimeric antibody is XENCS562 from FIG. 50; that is, the VH from the BTLA Fab is added N-terminally to the Fab Chain of XENCS562 and the VL from the BTLA Fab is added N-terminally to the Light Chain of XENCS562.

Anti-BTLA sequences suitable for use as ABDs include SEQ ID NOs: 20885-21503 and SEQ ID NOs: 36707-36738 (s will be understood from those in the art, these sequence identifiers come in "pairs" for the variable heavy and light chains, as will be apparent from the sequence identifiers); anti-BTLA ABD selected from the pairs of SEQ ID NOs: 36707 and 36711, 36715 and 36719, 36723 and 36727 and 36761 and 36735; with the Fab anti-BTLA ABD of XENP20269 (VH SEQ ID NO:20936 and VL SEQ ID NO:20941) finding particular use. In these embodiments, the remainder of the heterodimeric antibody is XENCS563 from FIG. 50; that is, the VH from the BTLA Fab is added N-terminally to the Fab Chain of XENCS563 and the VL from the BTLA Fab is added N-terminally to the Light Chain of XENCS563.

XII. NUCLEIC ACIDS OF THE INVENTION

The invention further provides nucleic acid compositions encoding the heterodimeric bispecific antibodies of the invention as well as the monospecific antibodies outlined herein.

As will be appreciated by those in the art, the nucleic acid compositions will depend on the format and scaffold of the heterodimeric protein. Thus, for example, when the format requires three amino acid sequences, such as for the triple F format (e.g. a first amino acid monomer comprising an Fc domain and a scFv, a second amino acid monomer comprising a heavy chain and a light chain), three nucleic acid sequences can be incorporated into one or more expression vectors for expression. Similarly, some formats (e.g. dual scFv formats such as disclosed in FIG. 1) only two nucleic acids are needed; again, they can be put into one or two expression vectors.

As is known in the art, the nucleic acids encoding the components of the invention can be incorporated into expression vectors as is known in the art, and depending on the host cells used to produce the heterodimeric antibodies of the invention. Generally the nucleic acids are operably linked to any number of regulatory elements (promoters, origin of replication, selectable markers, ribosomal binding sites, inducers, etc.). The expression vectors can be extra-chromosomal or integrating vectors.

The nucleic acids and/or expression vectors of the invention are then transformed into any number of different types of host cells as is well known in the art, including mammalian, bacterial, yeast, insect and/or fungal cells, with mammalian cells (e.g. CHO cells), finding use in many embodiments.

In some embodiments, nucleic acids encoding each monomer and the optional nucleic acid encoding a light chain, as applicable depending on the format, are each contained within a single expression vector, generally under different or the same promoter controls. In embodiments of particular use in the present invention, each of these two or three nucleic acids are contained on a different expression vector. As shown herein and in 62/025,931, hereby incorporated by reference, different vector ratios can be used to drive heterodimer formation. That is, surprisingly, while the proteins comprise first monomer:second monomer:light chains (in the case of many of the embodiments herein that have three polypeptides comprising the heterodimeric antibody) in a 1:1:2 ratio, these are not the ratios that give the best results.

The heterodimeric antibodies of the invention are made by culturing host cells comprising the expression vector(s) as is well known in the art. Once produced, traditional antibody purification steps are done, including an ion exchange chromatography step. As discussed herein, having the pIs of the two monomers differ by at least 0.5 can allow separation by ion exchange chromatography or isoelectric focusing, or other methods sensitive to isoelectric point. That is, the inclusion of pI substitutions that alter the isoelectric point (pI) of each monomer so that such that each monomer has a different pI and the heterodimer also has a distinct pI, thus facilitating isoelectric purification of the "triple F" heterodimer (e.g., anionic exchange columns, cationic exchange columns). These substitutions also aid in the determination and monitoring of any contaminating dual scFv-Fc and mAb homodimers post-purification (e.g., IEF gels, cIEF, and analytical IEX columns).

XIII. BIOLOGICAL AND BIOCHEMICAL FUNCTIONALITY OF THE HETERODIMERIC CHECKPOINT ANTIBODIES

Generally the bispecific antibodies of the invention are administered to patients with cancer, and efficacy is assessed, in a number of ways as described herein. Thus, while standard assays of efficacy can be run, such as cancer load, size of tumor, evaluation of presence or extent of metastasis, etc., immuno-oncology treatments can be assessed on the basis of immune status evaluations as well. This can be done in a number of ways, including both in vitro and in vivo assays. For example, evaluation of changes in immune status (e.g. presence of ICOS+ CD4+ T cells following ipi treatment) along with "old fashioned" measurements such as tumor burden, size, invasiveness, LN involvement, metastasis, etc. can be done. Thus, any or all of the following can be evaluated: the inhibitory effects of the checkpoints on CD4+ T cell activation or proliferation, CD8+ T (CTL) cell activation or proliferation, CD8+ T cell-mediated cytotoxic activity and/or CTL mediated cell depletion, NK cell activity and NK mediated cell depletion.

In some embodiments, assessment of treatment is done by evaluating immune cell proliferation, using for example, CFSE dilution method, Ki67 intracellular staining of immune effector cells, and 3H-Thymidine incorporation method, In some embodiments, assessment of treatment is done by evaluating the increase in gene expression or increased protein levels of activation-associated markers, including one or more of: CD25, CD69, CD137, ICOS, PD1, GITR, OX40, and cell degranulation measured by surface expression of CD107A.

In general, gene expression assays are done as is known in the art.

In general, protein expression measurements are also similarly done as is known in the art.

In some embodiments, assessment of treatment is done by assessing cytotoxic activity measured by target cell viability detection via estimating numerous cell parameters such as enzyme activity (including protease activity), cell membrane permeability, cell adherence, ATP production, co-enzyme production, and nucleotide uptake activity. Specific examples of these assays include, but are not limited to, Trypan Blue or PI staining, 51Cr or 35S release method, LDH activity, MTT and/or WST assays, Calcein-AM assay, Luminescent based assay, and others.

In some embodiments, assessment of treatment is done by assessing T cell activity measured by cytokine production, measure either intracellularly in culture supernatant using cytokines including, but not limited to, IFNγ, TNFα, GM-CSF, IL2, IL6, IL4, IL5, IL10, IL13 using well known techniques.

XIV. EXAMPLES

A. Example 1 Investigating In Vitro Binding of XmAb22841

1. 1A: XmAb20717 Simultaneously Occupies PD-1 and CTLA-4 Expressed on the Surface of Cells HEK293T cells stably expressing CTLA-4 (Crown Bioscience, Santa Clara, Calif.) were transfected with a pCMV6-AC-GFP vector encoding PD-1 (OriGene, Rockville, Md.). 3 days after transfection, cells were treated with indicated test articles for 30 minutes at 4° C. Following incubation, cells were washed two times and stained with Pacific Blue-conjugated XENP20111 (a one-armed scFv-Fc based on the anti-PD-1 arm from XmAb20717) and APC-conjugated XENP20059 (a one-armed Fab-Fc based on the anti-CTLA-4 arm from XmAb20717) for 30 minutes at 4° C. and assayed by flow cytometry. FIGS. 57A-57B and FIG. 58 show receptor occupancy following treatment with the various test articles as depicted by percentage of various populations of GFP+ (CTLA-4+PD-1+) HEK293T cells with unoccupied CTLA-4 and/or PD-1 receptors as indicated by staining. For example, occupancy of CTLA-4 receptors decreases the percentage of PD-1$^+$CTLA-4$^+$ and PD-1$^-$CTLA-4$^+$ populations and increases the percentage of PD-1$^+$CTLA-4$^-$ and PD-1$^-$ CTLA-4$^-$ populations. FIGS. 57A-57B shows the prevalence of PD-1$^+$CTLA-4$^+$ and PD-1$^-$ CTLA-4$^-$. FIG. 58 shows scatter plots depicting the prevalence of various populations following treatment with 12.5 µg/mL of indicated test articles. The data show that XmAb20717 selectively targets cells simultaneously expressing PD-1 and CTLA-4.

B. Example 2: XmAb20717 Enhances Allogeneic Anti-Tumor Responses in Mice

NOD SCID gamma (NSG) mice were engrafted with KG1A-luc cancer cells on Day 0. On Day 21, human PBMCs were engrafted into the intraperitoneally into the mice. After PBMC engraftment, indicated test articles were dosed weekly by intraperitoneal injection (control mice were dosed with PBS) for 4 weeks (or 4 total doses). Tumor growth was monitored by measuring total flux per mouse using an in vivo imaging system (IVIS® Lumina III) and data are shown (days post 1$^{st}$ dose) in
FIGS. 59A-59B.

C. Example 3: Investigating In Vitro Binding of XmAb22841

1. XmAb22841 Binding to HEK293T Expressing CTLA-4 and LAG-3

HEK293T cells stably expressing CTLA-4 (Crown Bioscience, Santa Clara, Calif.) were transfected with a pCMV6-AC-GFP vector encoding LAG-3 (OriGene, Rockville, Md.). 3 days after transfection, cells were incubated with of the following test articles at the indicated concentrations for 30 minutes at 4° C.: XmAb22841; XENP16433, a bivalent mAb based on the parental done from which the anti-CTLA-4 arm of XmAb22841 was derived; XENP16436, a bivalent mAb based on the parental done from which the anti-LAG-3 arm of XmAb22841 was derived; XENP24893, a one-armed scFv-Fc based on the anti-CTLA-4 arm from XmAb22841; XENP24895, a one-armed Fab-Fc based on the anti-LAG-3 arm from XmAb22841; and XENP15074, a bivalent anti-RSV mAb as a control. Following incubation, cells were washed two times and binding was detected with an anti-human-Fc-A647 conjugated secondary antibody (Jackson Immunoresearch, West Grove, Pa.). MFI indicating binding of test articles to GFP+ cells (i.e. CTLA-4+LAG-3+) are depicted in FIG. 60.

2. Occupancy of CTLA-4 and LAG-3 on HEK293T Expressing CTLA-4 and LAG-3 by XmAb22841

HEK293T cells stably expressing CTLA-4 (Crown Bioscience, Santa Clara, Calif.) were transfected with a pCMV6-AC-GFP vector encoding LAG-3 (OriGene, Rockville, Md.). 3 days after transfection, cells were treated with the following test articles for 30 minutes at 4° C.: XmAb22841, XENP16433, XENP16436, XENP24893, XENP24895, and XENP15074. Following incubation, cells were washed two times and stained with Pacific Blue-conjugated XENP24895 and A647-conjugated XENP23552. FIGS. 61A-61D show receptor occupancy following treatment with the various test articles as depicted by percentage of various populations of GFP+ (CTLA-4+LAG-3+) HEK293T cells with unoccupied CTLA-4 and/or LAG-3 receptors as indicated by staining. For example, occupancy of CTLA-4 receptors decreases the percentage of LAG-3+ CTLA-4+ and LAG-3-CTLA-4+ populations and increases the percentage of LAG-3+CTLA-4- and LAG-3-CTLA-4- populations. FIGS. 62A-62B respectively show the amount of unoccupied LAG-3 and CTLA-4 receptors on GFP+ cells following treatment with test articles as indicated by XENP24895 and XENP23552 binding.

3. XmAb22841 Binding to SEB-Stimulated T Cells

Binding of XmAb22841 to T cells was measured in an SEB-stimulated PBMC assay. Staphylococcal Enterotoxin B (SEB) is a superantigen that causes T cell activation and proliferation in a manner similar to that achieved by activation via the T cell receptor (TCR), including expression of checkpoint receptors such as LAG-3 and CTLA-4. Accordingly, human PBMCs from 6 donors were stimulated with 500 ng/mL SEB for 3 days. Cells were then treated with indicated concentrations of the indicated test articles for 30 minutes. Following incubation, cells were washed and stained with an anti-human-Fc-A647 antibody (Jackson Immunoresearch). MFI indicating binding of test articles to CD3+ T cells are depicted in FIGS. 63A-63F respectively for each donor.

The data show that, in PBMCs from each of the donors, XmAb22841 binds more avidly to CD3+ T cells compared to monospecific controls, demonstrating that binding to human T cells is significantly better by bispecific antibody XmAb22841, where each arm monovalently binds a different antigen, than by monospecific antibodies.

D. Example 4: Investigating Cytokine Release and Immune-Related Gene Expression Profiles Following Treatment with Bispecific Checkpoint Antibodies Human PBMCs were stimulated with 100 ng/mL SEB for 2 days. Following stimulation, cells were washed twice then restimulated with 100 ng/mL SEB and 20 µg/mL indicated test articles. Cell supernatant was collected 24 hours post treatment and assayed for IL-2 and IFNγ by a multiplexed assay on MULTI-SPOT 384-Well Spot plates (Meso Scale Discovery, Rockville, Md.). RNA was extracted from cells and assayed by nCounter® PanCancer Immune Profiling Panel (NanoString Technologies, Seattle, Wash.) which assays 770 target genes covering immune response.

FIG. 64 and FIG. 65 respectively depicts the fold increase in IL-2 and IFNγ following treatment by anti-PD-1 mAb (XENP16432), XmAb20717, and XmAb22841 as well as XmAb22841 in combination with anti-PD-1 mAb, in comparison to anti-RSV mAb (XENP15074). Notably, combination of XmAb22841 with anti-PD-1 mAb resulted in significantly more cytokine release than by either alone, demonstrating the advantage of a triple immune checkpoint blockade. FIG. 66 to FIG. 72 show the fold change in expression of various genes (as determined by Nanostring nCounter®) between the bispecific checkpoint antibodies, anti-PD-1 mAb, and anti-RSV mAb.

E. Example 5: Generation of Anti-PD-1 Clone 1C11

1. Generation and Screening of Anti-PD-1 Hybridoma

To develop additional PD-1 targeting arms, monoclonal antibodies were first generated by hybridoma technology through ImmunoPrecise, through their Standard Method and Rapid Prime Method. For the Standard Method, antigen(s) was injected into 3 BALB/c mice. 7-10 days before being sacrificed for hybridoma generation, the immunized mice received an antigen boost. Antibody titre is evaluated by ELISA on the antigen and the best responding mice are chosen for fusion. A final antigen boost is given 4 days prior to fusion. Lymphocytes from the mice are pooled, purified then fused with SP2/0 myeloma cells. Fused cells are grown on HAT selective Single-Step cloning media for 10-12 days at which point the hybridomas were ready for screening. For the Rapid Prime method, antigen(s) was injected into 3 BALB/c mice. After 19 days, lymphocytes from all the mice are pooled, purified then fused with SP2/0 myeloma cells. Fused cells were grown on HAT selective Single-Step cloning media for 10-12 days at which point the hybridomas were ready for screening. Antigen(s) used were mouse Fc fusion of human PD-1 (huPD-1-mFc), mouse Fc fusion of cyno PD-1 (cynoPD-1-mFc), His-tagged human PD-1 (huPD-1-His), His-tagged cyno PD-1 (cynoPD-1-His) or mixtures thereof.

Anti-PD-1 hybridoma clones generated as described above were subject to two rounds of screening using Octet, a BioLayer Interferometry (BLI)-based method. Experimental steps for Octet generally included the following: Immobilization (capture of ligand or test article onto a biosensor); Association (dipping of ligand- or test article-coated biosensors into wells containing serial dilutions of the corresponding test article or ligand); and Dissociation (returning of biosensors to well containing buffer) in order to determine the affinity of the test articles. A reference well containing buffer alone was also included in the method for background correction during data processing.

For the first round, anti-mouse Fc (AMC) biosensors were used to capture the clones with dips into 500 nM of bivalent human and cyno PD-1-Fc-His. For the second round, clones identified in the first round that were positive for both human and cyno PD-1 were captured onto AMC biosensors and dipped into 500 nM monovalent human and cyno PD-1-His.

2. Characterization of Clone 1C11

One hybridoma clone identified in Example 1 was clone 1C11. DNA encoding the VH and VL of hybridoma clone 1C11 were generated by gene synthesis and subcloned using standard molecular biology techniques into expression vector pTT5 containing human IgG1 constant region with E233P/L234V/L235A/G236del/S267K substitutions to generate XENP21575, sequences for which are depicted in FIG. 9.

3. PD-L1 Blocking with Clone 1C11

Blocking of checkpoint receptor/ligand interaction is necessary for T cell activation. The blocking ability of XENP21575 was investigated in a cell binding assay, with XENP16432 (anti-PD-1 mAb with variable regions of nivolumab), XENP21461 (anti-PD-1 mAb with variable regions of pembrolizumab), and XENP15074 (anti-RSV Mab with variable regions of motavizumab) as controls. HEK293T cells transfected to express PD-1 were incubated with XENP21575, as well as control antibodies. Following incubation, a murine Fc fusion of PD-L1 was added and allowed to incubate. Binding of PD-L1-mFc to HEK293T cells was detected with an anti-murine IgG secondary antibody, data for which are depicted in FIG. 10. The data shows that PD-L1 blocking by XENP21575 was similar to blocking by XENP16432 and XENP21461.

4. T Cell Surface Binding of Clone 1C11

Binding of anti-PD-1 clone 1C11 to T cells was measured in an SEB-stimulated PBMC assay. Staphylococcal Enterotoxin B (SEB) is a superantigen that causes T cell activation and proliferation in a manner similar to that achieved by activation via the T cell receptor (TCR), including expression of checkpoint receptors such as PD-1. Human PBMCs were stimulated with 100 ng/mL for 3 days. Following stimulation, PBMCs were incubated with the indicated test articles at indicated concentrations at 4° C. for 30 min. PBMCs were stained with anti-CD3-FITC (UCHT1) and APC labeled antibody for human immunoglobulin κ light chain. The binding of the test articles to T cells as indicated by APC MFI on FITC+ cells is depicted in FIG. 11.

5. T Cell Activation by Clone 1C11

T cell activation by clone 1C11, as indicated by cytokine secretion, was investigated in an SEB-stimulated PBMC assay. Human PBMCs were stimulated with 500 ng/mL SEB for 2 days. Cells were then washed twice in culture medium and stimulated with 500 ng/mL SEB in combination with indicated amounts of indicated test articles for 24 hours. Supernatants were then assayed for IL-2 and IFNγ by cells, data for which are depicted in FIG. 12A-12B.

6. Humanization of Clone 1C11

Clone 1C11 humanized using string content optimization (see, e.g., U.S. Pat. No. 7,657,380, issued Feb. 2, 2010). DNA encoding the heavy and light chains were generated by gene synthesis and subcloned using standard molecular biology techniques into the expression vector pTT5. Sequences for illustrative humanized variants of clone 1C11 in bivalent antibody format are depicted in FIGS. 13A-13C.

The affinity of XENP22553 was determined using Octet as generally described in Examples. In particular, anti-human Fc (AHC) biosensors were used to capture the test article with dips into multiple concentrations of histidine-tagged PD-1. The affinity result and corresponding sensorgram are depicted in FIG. 14.

7. Stability Optimization of a Humanized Variant of Clone 1C11 in the scFv Format The variable regions of anti-PD-1 clone 1C11 humanized variant H3L3 (as in XENP22553) were engineered for improved stability (while maintaining affinity) in the context of an scFv, for example, for use in a bispecific antibody. DNA encoding an scFv with the variable heavy and variable light regions of XENP22553 were generated by gene synthesis and subcloned using standard molecular biology techniques into the expression vector pTT5. The C-terminus of the scFv included a polyhistidine tag for purification. A library of scFv variants was then constructed by standard mutagenesis, illustrative sequences for which are depicted in FIG. 15A-15T (although polyhistidine tags have been removed).

Stability of scFv-His was evaluated using Differential Scanning Fluorimetry (DSF). DSF experiments were performed using a Bio-Rad CFX Connect Real-Time PCR Detection System. Proteins were mixed with SYPRO Orange fluorescent dye and diluted to 0.2 mg/mL in PBS. The final concentration of SYPRO Orange was 10X. After an initial 10 minute incubation period of 25° C., proteins were heated from 25 to 95° C. using a heating rate of 1° C./min. A fluorescence measurement was taken every 30 sec. Melting temperatures (Tm) were calculated using the instrument software. Stability results are depicted in FIG. 17A-17Q. The data show that melting temperature (Tm) increased by up to 19° C.

To determine the affinity of the variants, the variable regions from the scFvs were formatted as Fabs in a bivalent IgG1 with E233P/L234V/L235A/G236del/S267K substitutions. Illustrative sequences are depicted in FIGS. 16A-16H. DNA encoding the heavy and light chains were generated by gene synthesis and subcloned using standard molecular biology techniques into pTT5 expression vector containing IgG1 constant regions, and transiently transfected into HEK293E cells. Affinity screens of supernatant were performed using Octet. Anti-human Fc (AHC) biosensors were used to capture 1:2 dilutions of each supernatant to a density of 2.0 nm, and dipped into PD-1-His for KD determination. Affinity results are depicted in FIG. 17A-17Q.

8. Affinity Optimization of a Humanized Variant of Done 1C11 in the Fab Format

The variable regions of anti-PD-1 clone 1C11 humanized variant H3L3 (as in XENP22553) was generated in the Fab format and engineered for optimized affinity, for example, for use as a bivalent, monospecific antibody or for use in a bispecific antibody.

In a first library, variable heavy and light regions from scFvs generated in Example 4D found to have increased affinity were combined to generate bivalent IgG1 format with E233P/L234V/L235A/G236del/S267K substitutions, illustrative sequences for which are depicted in FIGS. 20A-20L. DNA encoding the heavy and light chains were generated by gene synthesis and subcloned using standard molecular biology techniques into pTT5 expression vector containing IgG1 constant regions, and transiently transfected into HEK293E cells. Antibodies were purified by Protein A chromatography, and affinity screens were performed using Octet. AHC biosensors were used to capture antibodies, and dipped into multiple concentrations of PD-1-His for KD determination. Affinity results are depicted in FIG. 19.

In a second library, additional variants were constructed by standard mutagenesis on the expression vectors encoding either the heavy or light chains of XENP22553. Illustrative sequences for the additional heavy chain and light chain variants are depicted in FIGS. 20A-20L and FIGS. 21A-21G. Expression vectors containing DNA encoding the additional heavy chain variants and DNA encoding the light chain of XENP22553, or DNA encoding the heavy chain of XENP22553 and DNA encoding the additional light chain variants were transiently transfected into HEK293E cells. Affinity screens of supernatant were performed using Octet. Anti-human Fc (AHC) biosensors were used to capture 1:2 dilutions of each supernatant to a density of 2.0 nm, and dipped into PD-1-His for KD determination. Affinity results are depicted in FIGS. 22A-22E. In a follow-up screen, DNA encoding selected antibodies were transfected into HEK293E cells, and antibodies were purified by Protein A chromatography and screened for affinity using Octet. Anti-human Fc (AHC) biosensors were used to capture antibodies, and dipped into multiple concentrations of PD-1-His for KD determination, results for which are depicted in FIG. 23.

Another library was generated as generally described above. Illustrative sequences for resulting antibodies are depicted in FIGS. 24A-24J. DNA encoding selected antibodies were transfected into HEK293E cells, and antibodies were purified by Protein A chromatography and screened for affinity using Octet. Anti-human Fc (AHC) biosensors were used to capture antibodies, and dipped into multiple concentrations of PD-1-His for KD determination, results for which are depicted in FIG. 25.

9. Affinity Screen of Affinity Optimized 1C11 Variants as Determined by Biacore

Affinity of 1C11 variants generated as described above and control mAbs based on nivolumab (XENP16432) and pembrolizumab (XENP21461) were determined using Biacore, a surface plasmon resonance (SPR)-based technology. Experimental steps for Biacore generally included the following: Immobilization (capture of ligand onto a sensor chip); Association (flowing of various concentrations of analyte over sensor chip); and Dissociation (flowing buffer over the sensor chips) in order to determine the affinity of the test articles. A reference flow with buffer alone was also included in the method for background correction during data processing. Binding affinities and kinetic rate constants were obtained by analyzing the processed data using a 1:1 binding model. In particular, anti-PD-1 mAbs were captured onto Protein A sensor chips, and then multiple concentrations of histidine-tagged human PD-1 or histidine tagged cyno PD-1 were flowed over the sensor chips. The resulting dissociation constants (KD) are depicted in FIG. 26.

10. T Cell Surface Binding of Affinity Optimized 1C11 Variants

Binding of affinity optimized 1C11 variants to T cells was measured in an SEB-stimulated PBMC assay. Human PBMCs were stimulated with 500 ng/mL SEB for 3 days. Following stimulation, PBMCs were incubated with the indicated test articles at indicated concentrations 30 min. PBMCs were stained with anti-CD3-FITC (UCHT1) and A647 labeled antibody for human Fc. The binding of the test articles to T cells as indicated by A647 MFI on FITC+ cells is depicted in FIG. 27.

11. Blocking of PD-L1 and PD-L2 Binding to PD-1 by Affinity Optimized 1C11 Variants The ability of affinity optimized 1C11 variants to block PD-L1 and PD-L2 binding to PD-1 was investigated in a tandem epitope binning assay using the Octet HTX instrument. Experimental steps for Octet were as generally described in Examples. In particular, murine Fc fusion of human PD-1 was loaded onto AMC (anti-mouse Fc capture) biosensors prior to dipping into 100 nM of a first test article (as indicated on the left side of the table depicted in FIG. 28) and then into 100 nM of a second test article (as indicated on the top of the table depicted in FIG. 28). Test articles included affinity optimized variants of humanized done 1C11 and Fc fusions of PD-L1 and PD-L2 (RnD Systems, Minneapolis, Minn.). The BLI-response of each test article pair was normalized against the response from dipping the biosensor into HBS-EP buffer and then dipping into the test article. The normalized BLI-responses of each pair of test articles are depicted in. If the second test article provided a normalized BLI-response less than 0.4, the binding of the second test article to PD-1 was considered to be blocked by the first test article. If the second test article provided a normalized BLI-response between 0.4 and 0.6, the blocking is considered borderline. If the second test article provided a normalized BLI-response greater than 0.6, the binding of the second test article to PD-1 was considered to not be blocked by the first test article. The data show that each of the anti-PD-1 1C11 variants blocked PD-L1 and PD-L2 binding to PD-1.

F. Example 6: Further Engineering Affinity Optimized 1C11 Variants

We engineered further 1C11 variants to modulate PD-1 affinity using the aforementioned approaches as well as by mixing and matching substitutions that appeared to best modulate affinity. In addition, we combined variant 1C11 variable heavy chains with variant 1C11 variable light chains demonstrating favorable affinity modulation. Illustrative sequences for resulting antibodies are depicted in FIGS. 40A-40BB.

1. Affinity Screen of Additional Affinity-Engineered 1C11 Variants

Affinity of the additional affinity-engineered 1C11 variants were determined using Octet, as generally described above. In particular, AHC biosensor was used to capture the 1C11 variants and dipped into multiple concentrations of His-tagged human PD-1 (as well as His-tagged cynomolgus PD-1 for the data depicted in FIG. 41). The resulting dissociation constants (KD), association rates (ka), and dissociation rates (kd) are depicted in FIG. 41 to FIG. 45, where each Figure depicts separate experimental sets.

2. Induction of Cytokine Secretion by 1C11 Variants in an SEB-Stimulated PBMC Assay While there was technical variability between experiments as well as between data obtained from Octet or Biacore, the affinity of 1C11_H3L3 (as determined by Octet) was generally in the range of 15-19 nM (from 4/6 experiments). From the various rounds of engineering, we obtained 1C11 variants having much tighter affinities (e.g. XENP26940 having affinity ranging from 0.51-0.74 nM; and XENP28652 having an affinity of 0.77 nM as determined by Octet) as well as variants having much weaker affinities (e.g. XENP26928 having an affinity of 333 nM as determined by Octet) for human PD-1. Accordingly, we investigated T cell activation by the variants with differing affinities, as indicated by cytokine secretion, in an SEB-stimulated PBMC assay. PBMC from 18 unique donors were stimulated with 100 ng/mL SEB for 2 days. Cells were then washed and restimulated with SEB and 20 µg/mL of the test articles. Data depicting IFNγ and IL-2 secretion are depicted respectively in FIG. 46 and FIG. 47. The data suggest a correlation between activity of the 1C11 variants and their affinity as indicated by the weaker binding affinity of XENP26928 and a corresponding weaker induction of cytokine secretion.

In summary, we identified novel anti-PD-1 mAb 1C11, which when humanized as 1C11_H3L3 (XENP22533) has a similar affinity compared to an anti-PD-1 mAb XENP16432 based on nivolumab (respectively 8.6 nM and 4.5 nM as determined by Biacore; respectively –18 nM and 10 nM as determined by Octet). Despite the similar affinity, XENP22533 binds T cells more tightly than XENP16432 as depicted in FIG. 11. We engineered XENP22533 to produce variants with modulated affinities over two orders of magnitude toward PD-1 as measured by Octet. This "affinity ladder" should prove useful in identifying the optimal affinity toward PD-1 that can best navigate the complex physiological behaviors of PD-1 receptor recycling, antibody: antigen complex lifetime, and antibody serum half-life. These factors will be explored in future in vivo mouse tumor models.

G. Example 7: Triple Checkpoint Blockade with XmAb22841 and αPD-1 Enhances Cytokine Secretion from SEB-Stimulated Cells Human PBMCs were stimulated with 100 ng/mL SEB for 2 days. Cells were washed two times and restimulated with 100 ng/mL SEB and 20 µg/mL indicated test articles for 24 hours. Cell supernatants were collected and assayed for IFNγ and IL-2 secretion as depicted in FIG. 29 and FIG. 30. The data show that triple checkpoint blockade enabled by a combination of XmAb22841 and XENP16432 (a bivalent αPD-1 mAb with ablated effector function based on nivolumab) enhance cytokine secretion beyond either XENP16432 or XmAb22841 alone. Notably, the combination of XmAb22841 and XENP16432 enhances cytokine secretion to a similar level as triple checkpoint blockade by a combination of XENP16432, XENP16433 (a bivalent αCTLA-4 mAb with ablated effector function based on ipilimumab), and XENP16436 (a bivalent αLAG-3 mAb with ablated effector function based on 25F7).

H. Example 8: Avidity of XmAb22841 is Responsible for Cytokine Release from MLR PBMCs from 2 unique donors were mixed (400,000 cells/donor) and incubated with the 20 µg/mL of the indicated test articles for 5 days. Following incubation, cells were assayed for IFNγ as depicted in FIG. 31. In a similar experiment, mixed PBMCs were incubated with various concentrations of indicated test articles for 5 days, and fold induction of IFNγ over PBS are depicted in FIG. 32. The data show that XmAb22841 enhances IFNγ secretion beyond a combination of XENP24895 (one-arm monovalent mAb based on anti-LAG-3 arm of XmAb22841) and XENP24893 (one-arm monovalent mAb based on anti-CTLA-4 arm of XmAb22841) demonstrating that avidity enabled by bivalent binding is necessary for enhancing cytokine release.

I. Example 9: Triple Checkpoint Blockade with XmAb22841 and αPD-1 Enhance GVHD in NSG Mice NOD SCID gamma (NSG) mice (10 per group) were engrafted via IV-OSP with 10×106 human PBMCs on Day 0. On Day 1, mice were dosed with XENP26842 (a bivalent αPD-1 mAb based on nivolumab with ablated effector function and M428L/N434S Xtend mutations; sequence depicted in FIG. 33), XmAb22841, a combination of XmAb22841 and XENP16432, or PBS for 4 weeks (4 total doses). Blood was drawn on Day 7, 14, and 21 to count various lymphocyte populations as depicted in FIG. 34 (for Day 14) and serum concentrations of IFNγ as depicted in FIG. 35 (for Day 7).

J. Example 10: Triple Checkpoint Blockade with XmAb22841 and αPD-1 Enhances Anti-Tumor Response in Mice NOD SCID gamma (NSG) mice (10 per group) were engrafted intradermally with 3×106 pp65-expressing MCF-7 cells in the rear flank on Day–14. On Day 0, mice were engrafted intraperitoneally with 5×106 human PBMCs from an HLA matched CMV+ donor that screened positive for T cell pp65 reactivity (or PBS for control mice). Mice were treated weekly with XENP16432, XmAb22841, a combination of XmAb22841 and XENP16432, or PBS (for control mice) for 4 weeks (4 total doses). Tumor volumes were monitored by caliper measurements, data for which are shown (days post 1st dose) in FIGS. 36A-36B. Blood was drawn on Day 7, 12, 19, and 26 and analyzed by flow cytometry to count various lymphocyte populations as depicted in FIGS. 37A-37D. The data show that lymphocyte counts (in particular CD8+ T cells) were similar with or without the various checkpoint inhibitors. However, treatment with the various test articles resulted in notably decreased tumor volume indicating enhanced anti-tumor response from de-repression of T cell activity by checkpoint blockade. Furthermore, the data show that triple checkpoint blockade enabled by the combination treatment with XmAb22841 (targeting CTLA-4 and LAG-3) and XENP16432 (targeting PD-1) synergistically enhanced anti-tumor response over treatment with either XmAb22841 or XENP16432 alone.

K. Example 11: Anti-PD-1 mAb 1C11 Enhances GVHD in PBMC-Engrafted NSG-Mice

In a GVHD study, we investigated the effect of humanized anti-PD-1 mAb 1C11_H3L3 (XENP22553). NSG mice were engrafted i.v. with 10×106 human PBMCs on Day 0, followed by treatment on Days 1, 8, 15, and 21 with the following test articles: PBS control, XENP16432 (an anti-PD-1 antibody based on nivolumab with E233P/L234V/L235A/G236del/S267K ablation variants), and XENP22553. FIG. 38 depicts the change in body weight of mice (as a percentage of initial body weight) over time, and FIGS. 39A-39C depicts human CD45+ cell, CD4+ T cell, and CD8+ T cell counts in mice blood over time.

L. Example 12: Xtend Fc Domain Extends the Half-Life of Anti-PD-1 x Anti-CTLA-4 Bispecific Antibody in hFcRn Transgenic Mice Tg276 transgenic hFcRn mice (hemizygous for hFcRn; n=5) were treated with 2 mg/kg XmAb20717 or XENP20053 (non-Xtend analog of XmAb20717) on Day 0. Whole blood samples were collected 1 hour post-treatment and on Days 2, 5, 8, 12, 15, 19, 22, 16, 29, 33, and 35. Test article concentration was detected using human PD-1 and human CTLA-4 antigen. PK interpretative analysis was performed using Phoenix WinNonlin software (Version 6.4.0.768) with PK parameters for non-compartmental analysis of free drug serum concentration versus time. Pharmacokinetic profile of XmAb20717 and XENP20053 in are depicted in FIGS. 76A-76B; half-life are depicted in FIG. 77; and Cmax are depicted in FIG. 78. Additional PK parameters are summarized in FIG. 79.

M. Example 13: XmAb20717 does not Induce Cytokine Release in Naive T Cells P BMCs were thawed overnight and treated with 20 μg/mL of indicated soluble or plate bound test articles for 24 hours. Anti-CD3 antibody was done OKT3. Cell supernatants were then collected and assayed with V-PLEX Proinflammatory Panel 1 Human Kit (Meso Scale, Rockville, Md.). Each point represents a unique human donor tested in technical singlet. Paired t tests were used to determine statistical significance (n.s. signifies a p-value >0.05). The data depicted in FIGS. 80A-80J show that XmAb20717 does not induce cytokine release (A: IFNγ; B: IL-1ß; C: IL-2; D: IL-4; E: IL-8; F: IL-6; G: IL-10; H: IL-12p70; I: IL-13; J: TNFα) in naive T cells.

N. Example 14: Further Characterization of Binding by XmAb20717

1. XmAb20717 Binds Human and Cynomolgus CTLA-4 and PD-1

Binding of XmAb20717 to human and cynomolgus CTLA-4 and PD-1 was characterized using Octet, a BioLayer Interferometry (BLI)-based method. Binding affinities were obtained by analyzing the processed data globally using a 1:1 binding model. Octet sensorgrams are shown in FIGS. 81A-81B and FIGS. 82A-82B. The resulting equilibrium dissociation constants (KD), association rate constants (ka), and dissociation constants (kd) are presented in FIG. 83. Affinities for both human and cynomolgus CTLA-4 were measured at approximately 4.1 and 23 nM respectively. Binding affinities for human and cyno PD-1 were 1.4 and 5.5 nM respectively.

2. XmAb20717 Competes for Binding with Ligands of CTLA-4 and PD-1

Binding of CD80 and CD86 to CTLA-4 with and without XmAb20717 and binding of PD-L1 and PD-L2 to PD-1 with and without XmAb20717 was characterized using Octet, a BioLayer Interferometry (BLI)-based method. Octet sensorgrams are shown in FIG. 84 and FIG. 85. In all cases, 100 nM CTLA-4 and 100 nM PD-1 show a binding signal with their ligands (CD80/CD86 and PDL1/PDL2 respectively). In the presence of excess XmAb20717, pre-incubated with CTLA-4 or PD-1 at room temperature for 1 hour prior to the experiment, there is no binding signal observed to any ligands due to the competition of XmAb20717 with CTLA-4 and PD-1 for their ligands CD80/CD86 and PD-L1/PD-L2, respectively.

3. XmAb20717 does not Bind FcγR

Binding of XmAb20717 to human, cynomolgus, and mouse FcγRs was characterized using Octet, a BioLayer Interferometry (BLI)-based method. A comparator antibody was also tested using similar methods: anti-CD19 antibody with a native IgG1 constant region. Octet sensorgrams are shown in FIG. 86 to FIG. 88. While the expected binding patterns for a native human IgG1 antibody were observed for the comparator antibody, no binding for any of the FcγRs was detected for XmAb20717.

4. XmAb20717 Binds Human, Cynomolgus, and Mouse FcRn at pH 6.0

Binding of XmAb20717 to human, cynomolgus, and mouse FcRn at pH 6.0 was characterized using Octet, a BioLayer Interferometry (BLI)-based method. A comparator antibody was also tested using similar methods: XENP20053, an anti-PD1 x anti-CTLA4 bispecific antibody containing the same variable regions and engineered constant regions as XmAb20717 but lacking the amino acid substitutions XmAb20717 contains for enhancing FcRn binding. Binding affinities were obtained by analyzing the processed data globally using a 1:1 Langmuir model. Octet sensorgrams are shown FIG. 90. The resulting equilibrium dissociation constants (KD) are presented FIG. 89. Affinities measured for XmAb20717 are tighter than those measured for the comparator, indicating that the Fc substitutions contained in XmAb20717 improve the affinity for FcRn at pH 6.0, the physiologically relevant pH for endosome trafficking.

5. XmAb20717 Simultaneously Binds PD-1 and CTLA-4

Binding of XmAb20717 to both PD1 and CTLA4 antigens was tested using an in-tandem dip approach using BLI technology on the Octet HTX instrument. First, biosensors were loaded with PD-1, then dipped into either XmAb20717 or buffer as a control, and finally, into CTLA-4. FIG. 91 shows the binding sensorgrams which indicate that XmAb20717 can bind to both antigens simultaneously. The XmAb20717 sensorgram continues to increase in signal during the final CTLA4 antigen dip while the control sensorgram with no XmAb20717 loaded remains flat.

O. Example 15: Further In Vitro Characterization of XmAb20717

1. XmAb20717 Promotes Greater IL-2 Secretion from SEB-Stimulated PBMCs Compared to an Anti-PD-1 Antibody PBMCs from 22 unique donors were stimulated with 500 ng/mL SEB for 48 h.

Cells were then washed two times in culture medium and re-stimulated with 500 ng/mL SEB plus 20 μg/mL of indicated test articles for 18 h. Culture supernatants were collected and assayed for IL-2 concentration by ELISA, data for which are depicted in FIG. 92.

2. XmAb20717 Suppresses IL-2 Secretion from Unstimulated Human PBMCs Compared to an Anti-PD-1 Antibody Unstimulated PBMCs from 22 unique donors were treated with 20 μg/mL of indicated test articles for 72 h. Culture supernatants were collected and assayed for IL-2 concentration by ELISA, data for which are depicted in FIG. 93.

3. XmAb20717 Promotes Greater IL-2 Secretion from Human Lymphocytes Compared to a Mixture of Component Arms that Comprises XmAb20717

PBMCs from 22 unique donors were stimulated with 500 ng/mL SEB for 48 hours (data from XENP15074 and XENP20717 replicated from FIG. 92). Cells were then washed two times in culture medium and re-stimulated with 500 ng/mL SEB and 20 μg/mL of indicated test articles for 18 hours. Culture supernatants were collected and assayed for IL-2 abundance by ELISA, data for which are depicted in FIG. 94.

P. Example 16: Further Analysis of In Vivo Studies in Murine Models

We further analyzed data from a GVHD study described in an earlier example. FIG. 95 depicts the mean change in body weight of mice (as a percentage of initial body weight) over time. FIG. 96 depicts the survival of mice over time. FIG. 97 depicts the mean IFNγ level over time in the mice. FIGS. 98A-98C depicts human CD45+ cell, CD4+ T cell, and CD8+ T cell counts in mice blood over time.

Q. Example 17: XmAb20717 Combines with PD-L1 Blockade in a GVHD Model

In another GVHD study, we investigated the combination of XmAb20717 with PD-L1 blockade (anti-PD-L1 mAb). NSG mice were engrafted i.v. with 10×106 human PBMCs on Day 0, followed by treatment on Days 1, 8, 15, and 21 with the following test articles: PBS control, XmAb20717, XENP16434 (an anti-PD-L1 antibody based on atezolizumab with E233P/L234V/L235A/G236del/S267K ablation variants; sequences depicted in FIG. 99), and XmAb20717 in combination with XENP16434. FIG. 100 depicts the change in body weight of mice (as a percentage of initial body weight) over time, FIG. 101 depicts the survival of mice over time, and FIGS. 102A-102C depicts human CD45+ cell, CD4+ T cell, and CD8+ T cell counts in mice blood on Day 14.

R. Example 18: Interaction of XmAb20717 with Comparator Anti-PD-1 Antibodies To determine if pembrolizumab or nivolumab can interfere with the binding activity of XmAb20717, 293T cells stably expressing PD-1-GFP and CTLA-4 were treated with nivolumab or pembrolizumab (16-point 2-fold serial dilutions beginning at 100 μg/mL) for 30 minutes at 4° C. The cells were washed twice with 200 4 ice-cold FACS buffer (3% FBS in PBS), and stained with XmAb20717 conjugated to Alexa647 (16 point 3-fold serial dilutions beginning at 200 μg/mL) on ice for 30 minutes. Cells were then analyzed by FACS for binding by XmAb20717, data for which are depicted in FIG. 103 and FIG. 104. Data depicted in FIG. 103 indicate that nivolumab does not significantly interfere with binding of XmAb20717 to PD-1+CTLA-4+ cells. Data depicted in FIG. 104 indicate that pembrolizumab does interfere with the binding of XmAb20717 to PD-1+CTLA-4+ cells; however, data depicted in FIG. 105 indicate that interference by pembrolizumab can be overcome with high concentrations of XmAb20717. This suggests that XmAb20717 may be administered in a subject in combination with or subsequent to treatment with nivolumab or pembrolizumab.

S. Example 19: XmAb22841 does not Induce Cytokine Release in Naive T Cells and is not Superagonistic PBMCs were thawed overnight and treated with 20 μg/mL of indicated soluble or plate bound test articles for 24 hours. Anti-CD3 antibody was done OKT3. Cell supernatants were then collected and assayed with V-PLEX Proinflammatory Panel 1 Human Kit (Meso Scale, Rockville, Md.). Each point represents a unique human donor tested in technical singlet. Paired t tests were used to determine statistical significance (n.s. signifies a p-value >0.05). The data depicted in FIGS. 106A-106J show that XmAb22841 does not induce cytokine release (A: IFNγ; B: IL-18; C: IL-2; D: IL-4; E: IL-8; F: IL-6; G: IL-10; H: IL-12p70; I: IL-13; J: TNFα) in naive T cells.

Superagonstic properties of XmAb22841 was also assessed by air-drying per the Stebbings protocol (Stebbings R. et al. 2007). Air-drying of test articles was achieved by drying in a SpeedVac™ for 2 hours at room temperature. Human PBMCs were treated for 24 hours with 10 μg of air-dried XmAb22841, and activity was compared to 10 μg of air-dried XENP15074 (anti-RSV negative isotype control) or the superagonist TGN1412 (XENP29154; sequences for which are depicted in FIG. 107). TGN1412 did not possess any activity when bound to the assay plate using an aqueous adsorption method; however, air-dried TGN1412 promoted IFNγ, IL-1β, IL-2, IL-4, IL-6, IL-8, IL-10, IL-13, and TNF cytokine secretion from unstimulated human PBMC. In comparison, the cytokine levels in PBMCs treated with air-dried XmAb22841 remained similar to the negative control of air-dried XENP15074 (data shown in FIGS. 108A-108J).

T. Example 20: Further Characterization of Binding by XmAb22841

1. XmAb22841 Binds Human and Cynomolgus CTLA-4 and LAG-3

Binding of XmAb22841 to human and cynomolgus CTLA-4 and LAG-3 was characterized using Octet, a Bio-Layer Interferometry (BLI)-based method. Binding affinities were obtained by analyzing the processed data globally using a 1:1 binding model. Octet sensorgrams are shown in FIGS. 109A-109B and FIGS. 110A-11B. The resulting equilibrium dissociation constants (KD), association rate constants (ka), and dissociation constants (kd) are presented in FIG. 111. Affinities for both human and cynomolgus CTLA-4 were measured at approximately 4.6 and 17.6 nM respectively. Binding affinities for human and cyno LAG-3 were 1.4 and 1.3 nM respectively.

2. XmAb22841 Competes for Binding with Ligands of CTLA-4 and LAG-3

Binding of CD80 and CD86 to CTLA-4 with and without XmAb22841 was characterized using Octet, a BioLayer Interferometry (BLI)-based method. Octet sensorgrams are shown in FIG. 112. In both cases, 100 nM CTLA-4 show a binding signal with their ligands (CD80/CD86). In the presence of excess XmAb22841, pre-incubated with CTLA-4 at room temperature for 1 hour prior to the experiment, there is no binding signal observed to any ligands due to the competition of XmAb22841 with CTLA-4 for its ligands CD80/CD86.

Soluble LAG-3 binds to MHC Class II expressed on the surface of cancer del lines. Therefore, we determined if XmAb22841 can block soluble LAG-3 binding to MHCII+ Ramos cells when complexed to XmAb22841. As depicted in FIG. 113, XmAb22841 dose-dependently blocked binding of soluble LAG-3 antigen to Ramos cells.

3. XmAb22841 does not Bind FcγR

Binding of XmAb22841 to human, cynomolgus, and mouse FcγRs was characterized using Octet, a BioLayer Interferometry (BLI)-based method. A comparator antibody was also tested using similar methods: anti-CD19 antibody with a native IgG1 constant region. Octet sensorgrams are shown in FIG. 114 to FIG. 116. While the expected binding patterns for a native human IgG1 antibody were observed for the comparator antibody, no binding for any of the FcγRs was detected for XmAb22841.

4. XmAb22841 Binds Human, Cynomolgus, and Mouse FcRn at pH 6.0

Binding of XmAb22841 to human, cynomolgus, and mouse FcRn at pH 6.0 was characterized using Octet, a BioLayer Interferometry (BLI)-based method. A comparator antibody was also tested using similar methods: XENP22602, an anti-CTLA-4 x anti-LAG-3 bispecific antibody containing the same variable regions and engineered constant regions as XmAb22841 but lacking the amino acid substitutions XmAb22841 contains for enhancing FcRn binding. Binding affinities were obtained by analyzing the processed data globally using a 1:1 Langmuir model. Octet sensorgrams are shown FIG. 118. The resulting equilibrium dissociation constants (KD) are presented FIG. 117. Affinities measured for XmAb22841 are tighter than those measured for the comparator, indicating that the Fc substitutions contained in XmAb22841 improve the affinity for FcRn at pH 6.0, the physiologically relevant pH for endosome trafficking.

5. XmAb22841 Simultaneously Binds CTLA-4 and LAG-3 approach using BLI technology on the Octet HTX instrument. First, biosensors were loaded with LAG3, then dipped into either XmAb22841 or buffer as a control, and finally, into CTLA4. FIG. 119 shows the binding sensorgrams which indicate that XmAb22841 can bind to both antigens simultaneously. The XmAb22841 sensorgram continues to increase in signal during the final CTLA4 antigen dip while the control sensorgram with no XmAb22841 loaded remains flat.

U. Example 21: Further Analysis of GVHD by XmAb22841 and PD-1 Blockade

We further analyzed data from a GVHD study investigating triple-checkpoint blockade by XmAb22841 and PD-1 blockade described in an earlier example. FIG. 120 depicts the mean change in body weight of mice (as a percentage of initial body weight) over time. FIG. 121 depicts the survival of mice over time. FIGS. 122A-122B depicts the IFNγ and IL-10 concentrations on Days 7 and 14.

SEQUENCE LISTING (44916 sequences)

SEQ ID NO: 1 - protein, 288 aa, Homo sapiens
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 2 - protein, 150 aa, Homo sapiens [sequence omitted]

SEQ ID NO: 3 - protein, 288 aa, Macaca fascicularis
MQIPQAPWPVVWAVLQLGWRPGWFLESPDRPWNAPTFSPALLLVTEGDNATFTCSFSNASESFVLNWYRMSPSNQTDKLAAFPEDRSQPGQDCRFRVTRLPNGRDFHMSVVRARRNDSGTYLCGAISLAPKAQIKESLRAELRVTERRAEVPTAHPSPSPRPAGQFQALVVGVVGGLLGSLVLLVWVLAVICSRAAQGTIEARRTGQPLKEDPSAVPVFSVDYGELDFQWREKTPEPPAPCVPEQTEYATIVFPSGLGTSSPARRGSADGPRSPRPLRPEDGHCSWPL

SEQ ID NO: 4 - protein, 150 aa, Macaca fascicularis
PGWFLESPDRPWNAPTFSPALLLVTEGDNATFTCSFSNASESFVLNWYRMSPSNQTDKLAAFPEDRSQPGQDCRFRVTRLPNGRDFHMSVVRARRNDSGTYLCGAISLAPKAQIKESLRAELRVTERRAEVPTAHPSPSPRPAGQFQALV

SEQ ID NO: 5 - protein, 223 aa, Homo sapiens
MACLGFQRHKAQLNLATRTWPCTLLFFLLFIPVFCKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDFLLWILAAVSSGLFFYSFLLTAVSLSKMLKKRSPLTTGVYVKMPPTEPECEKQFQPYFIPIN

SEQ ID NO: 6 - protein, 126 aa, Homo sapiens [sequence omitted]

SEQ ID NO: 7 - protein, 223 aa, Macaca fascicularis
MACLGFQRHKARLNLATRTRPYTLLFSLLFIPVFSKAMHVAQPAVVLANSRGIASFVCEYASPGKATEVRVTVLRQADSQVTEVCAATYMMGNELTFLDDSICTGTSSGNQVNLTIQGLRAMDTGLYICKVELMYPPPYYMGIGNGTQIYVIDPEPCPDSDFLLWILAAVSSGLFFYSFLLTAVSLSKMLKKRSPLTTGVYVKMPPTEPECEKQFQPYFIPIN

SEQ ID NO: 8 - protein, 126 aa, Macaca fascicularis
KAMHVAQPAVVLANSRGIASFVCEYASPGKATEVRVTVLRQADSQVTEVCAATYMMGNELTFLDDSICTGTSSGNQVNLTIQGLRAMDTGLYICKVELMYPPPYYMGIGNGTQIYVIDPEPCPDSD

SEQ ID NO: 9 - protein, 525 aa, Homo sapiens
MWEAQFLGLLFLQPLWVAPVKPLQPGAEVPVVWAQEGAPAQLPCSPTIPLQDLSLLRRAGVTWQHQPDSGPPAAAPGHPLAPGPHPAAPSSWGPRPRRYTVLSVGPGGLRSGRLPLQPRVQLDERGRQRGDFSLWLRPARRADAGEYRAAVHLRDRALSCRLRLRLGQASMTASPPGSLRASDWVILNCSFSRPDRPASVHWFRNRGQGRVPVRESPHHHLAESFLFLPQVSPMDSGPWGCILTYRDGFNVSIMYNLTVLGLEPPTPLTVYAGAGSRVGLPCRLPAGVGTRSFLTAKWTPPGGGPDLLVTGDNGDFTLRLEDVSQAQAGTYTCHIHLQEQQLNATVTLAIITVTPKSFGSPGSLGKLLCEVTPVSGQERFVWSSLDTPSQRSFSGPWLEAQEAQLLSQPWQCQLYQGERLLGAAVYFTELSSPGAQRSGRAPGALPAGHLLLFLILGVLSLLLLVTGAFGFHLWRRQWRPRRFSALEQGIHPPQAQSKIEELEQEPEPEPEPEPEPEPEPEPEQL

SEQ ID NO: 10 - protein, 422 aa, Homo sapiens
VPVVWAQEGAPAQLPCSPTIPLQDLSLLRRAGVTWQHQPDSGPPAAAPGHPLAPGPHPAAPSSWGPRPRRYTVLSVGPGGLRSGRLPLQPRVQLDERGRQRGDFSLWLRPARRADAGEYRAAVHLRDRALSCRLRLRLGQASMTASPPGSLRASDWVILNCSFSRPDRPASVHWFRNRGQGRVPVRESPHHHLAESFLFLPQVSPMDSGPWGCILTYRDGFNVSIMYNLTVLGLEPPTPLTVYAGAGSRVGLPCRLPAGVGTRSFLTAKWTPPGGGPDLLVTGDNGDFTLRLEDVSQAQAGTYTCHIHLQEQQLNATVTLAIITVTPKSFGSPGSLGKLLCEVTPVSGQERFVWSSLDTPSQRSFSGPWLEAQEAQLLSQPWQCQLYQGERLLGAAVYFTELSSPGAQRSGRAPGALPAGHL

SEQ ID NO: 11 - protein, 533 aa, Macaca fascicularis
  MOD_RES (74)..(74): Any amino acid
MWEAQFLGLLFLQPLWVAPVKPPQPGAEISVVWAQEGAPAQLPCSPTIPLQDLSLLRRAGVTWQHQPDSGPPAXAPGHPPVPGHRPAAPYSWGPRPRRYTVLSVGPGGLRSGRLPLQPRVQLDERGRQRGDFSLWLRPARRADAGEYRATVHLRDRALSCRLRLRVGQASMTASPPGSLRTSDWVILNCSFSRPDRPASVHWFRSRGQGRVPVQGSPHHHLAESFLFLPHVGPMDSGLWGCILTYRDGFNVSIMYNLTVLGLEPATPLTVYAGAGSRVELPCRLPPAVGTQSFLTAKWAPPGGGPDLLVAGDNGDFTLRLEDVSQAQAGTYICHIRLQGQQLNATVTLAIITVTPKSFGSPGSLGKLLCEVTPASGQEHFVWSPLNTPSQRSFSGPWLEAQEAQLLSQPWQCQLHQGERLLGAAVYFTELSSPGAQRSGRAPGALRAGHLPLFLILGVLFLLLLVTGAFGFHLWRRQWRPRRFSALEQGIHPPQAQSKIEELEQEPELEPEPELERELGPEPEPGPEPEPEQL

SEQ ID NO: 12 - protein, 422 aa, Macaca fascicularis
  MOD_RES (46)..(46): Any amino acid
ISVVWAQEGAPAQLPCSPTIPLQDLSLLRRAGVTWQHQPDSGPPAXAPGHPPVPGHRPAAPYSWGPRPRRYTVLSVGPGGLRSGRLPLQPRVQLDERGRQRGDFSLWLRPARRADAGEYRATVHLRDRALSCRLRLRVGQASMTASPPGSLRTSDWVILNCSFSRPDRPASVHWFRSRGQGRVPVQGSPHHHLAESFLFLPHVGPMDSGLWGCILTYRDGFNVSIMYNLTVLGLEPATPLTVYAGAGSRVELPCRLPPAVGTQSFLTAKWAPPGGGPDLLVAGDNGDFTLRLEDVSQAQAGTYICHIRLQGQQLNATVTLAIITVTPKSFGSPGSLGKLLCEVTPASGQEHFVWSPLNTPSQRSFSGPWLEAQEAQLLSQPWQCQLHQGERLLGAAVYFTELSSPGAQRSGRAPGALRAGHL

SEQ ID NO: 13 - protein, 289 aa, Homo sapiens
MKTLPAMLGTGKLFWVFFLIPYLDIWNIHGKESCDVQLYIKRQSEHSILAGDPFELECPVKYCANRPHVTWCKLNGTTCVKLEDRQTSWKEEKNISFFILHFEPVLPNDNGSYRCSANFQSNLIESHSTTLYVTDVKSASERPSKDEMASRPWLLYRLLPLGGLPLLITTCFCLFCCLRRHQGKQNELSDTAGREINLVDAHLKSEQTEASTRQNSQVLLSETGIYDNDPDLCFRMQEGSEVYSNPCLEENKPGIVYASLNHSVIGPNSRLARNVKEAPTEYASICVRS

SEQ ID NO: 14 - protein, 127 aa, Homo sapiens
KESCDVQLYIKRQSEHSILAGDPFELECPVKYCANRPHVTWCKLNGTTCVKLEDRQTSWKEEKNISFFILHFEPVLPNDNGSYRCSANFQSNLIESHSTTLYVTDVKSASERPSKDEMASRPWLLYR

SEQ ID NO: 15 - protein, 289 aa, Macaca fascicularis
MKTLPAMLGSGRLFWVVFLIPYLDIWNIHGKESCDVQLYIKRQSYHSIFAGDRFKLECPVKYCAHRPQVTWCKLNGTTCVKLEGRHTSWKQEKNLSFFILHFEPVLPSDNGSYRCSANFLSAIIESHSTTLYVTDVKSASERPSKDEMASRPWLLYSLLPLGGLPLLITTCFCLFCFLRRHQGKQNELSDTTRREITLVDVPFKSEQTEASTRQNSQVLLSETGIYDNEPDFCFRMQEGSEVYSNPCLEENKPGIIYASLNHSIIGLNARQARNVKEAPTEYASICVRS

SEQ ID NO: 16 - protein, 127 aa, Macaca fascicularis
KESCDVQLYIKRQSYHSIFAGDRFKLECPVKYCAHRPQVTWCKLNGTTCVKLEGRHTSWKQEKNLSFFILHFEPVLPSDNGSYRCSANFLSAIIESHSTTLYVTDVKSASERPSKDEMASRPWLLYS

SEQ ID NO: 17 - protein, 300 aa, Homo sapiens
MFSHLPFDCVLLLLLLLLTRSSEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPAKVTPAPTRQRDFTAAFPRMLTTRGHGPAETQTLGSLPDINLTQISTLANELRDSRLANDLRDSGATIRIGIYIGAGICAGLALALIFGALIFKWYSHSKEKIQNLSLISLANLPPSGLANAVAEGIRSEENIYTIEENVYEVEEPNEYYCYVSSRQQPSQPLGCRFAM

SEQ ID NO: 18 - protein, 181 aa, Homo sapiens
SEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPAKVTPAPTRQRDFTAAFPRMLTTRGHGPAETQTLGSLPDINLTQISTLANELRDSRLANDLRDSGATIRIG

SEQ ID NO: 19 - protein, 302 aa, Macaca fascicularis
MFSHLPFDCVLLLLLLLLTRSSEVEYIAEVGQNAYLPCSYTPAPPGNLVPVCWGKGACPVFDCSNVVLRTDNRDVNDRTSGRYWLKGDFHKGDVSLTIENVTLADSGVYCCRIQIPGIMNDEKHNVKLVVIKPAKVTPAPTLQRDLTSAFPRMLTTGEHGPAETQTPGSLPDVNLTVSNFFCELQIFTLTNELRDSGATIRTAIYIAAGISAGLALALIFGALIFKWYSHSKEKTQNLSLISLANIPPSGLANAVAEGIRSEENIYTIEEDVYEVEEPNEYYCYVSSGQQPSQPLGCRVAMP

SEQ ID NO: 20 - protein, 182 aa, Macaca fascicularis
SEVEYIAEVGQNAYLPCSYTPAPPGNLVPVCWGKGACPVFDCSNVVLRTDNRDVNDRTSGRYWLKGDFHKGDVSLTIENVTLADSGVYCCRIQIPGIMNDEKHNVKLVVIKPAKVTPAPTLQRDLTSAFPRMLTTGEHGPAETQTPGSLPDVNLTVSNFFCELQIFTLTNELRDSGATIRTA

SEQ ID NO: 21 - protein, 246 aa, Artificial Sequence
  Description of Artificial Sequence: Synthetic polypeptide
  XENP019533 [CTLA-4]_H0_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 22 - protein, 118 aa, Artificial Sequence
  Description of Artificial Sequence: Synthetic polypeptide
  VH of XENP019533
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 23 - protein, 108 aa, Artificial Sequence
  Description of Artificial Sequence: Synthetic polypeptide
  VL of XENP019533
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 24 - protein, 5 aa, Artificial Sequence
  Description of Artificial Sequence: Synthetic peptide
  XENP019533 vhCDR1
SYTMH

SEQ ID NO: 25 - protein, 17 aa, Artificial Sequence
  Description of Artificial Sequence: Synthetic peptide
  XENP019533 vhCDR2
FISYDGNNKYYADSVKG

SEQ ID NO: 26 - protein, 9 aa, Artificial Sequence
  Description of Artificial Sequence: Synthetic peptide
  XENP019533 vhCDR3
TGWLGPFDY

SEQ ID NO: 27 - protein, 12 aa, Artificial Sequence
  Description of Artificial Sequence: Synthetic peptide
  XENP019533 vlCDR1
RASQSVGSSYLA

SEQ ID NO: 28 - protein, 7 aa, Artificial Sequence
  Description of Artificial Sequence: Synthetic peptide
  XENP019533 vlCDR2
GAFSRAT

SEQ ID NO: 29 - protein, 9 aa, Artificial Sequence
  Description of Artificial Sequence: Synthetic peptide
  XENP019533 vlCDR3
QQYGSSPWT

SEQ ID NO: 30 - protein, 246 aa, Artificial Sequence
  Description of Artificial Sequence: Synthetic polypeptide
  XENP019534 [CTLA-4]_H0.36_L0.50_scFv(GKPGS)4
QVQLVESGGGVVQPGRSLRLSCAASGFTFSSYTMHWVRKAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQEKPGQAPRLLIYGAFSRATGIPDRFSGSGSGTDFTLTISRLEPEDFAVYYCQQYGSSPWTFGQGTKVEIK

SEQ ID NO: 31 - protein, 118 aa, Artificial Sequence
  Description of Artificial Sequence: Synthetic polypeptide
  VH of XENP019534
QVQLVESGGGVVQPGRSLRLSCAASGFTFSSYTMHWVRKAPGKGLEWVTFISYDGNNKYYADSVKGRFTISRDNSKNTLYLQMNSLRAEDTAIYYCARTGWLGPFDYWGQGTLVTVSS

SEQ ID NO: 32 - protein, 108 aa, Artificial Sequence
  Description of Artificial Sequence: Synthetic polypeptide
  VL of XENP019534
EIVLTQSPGTLSLSPGERATLSCRASQSVGSSYLAWYQEKPGQAPRLLIYGAFSRATGIPDRFSGSGSGTDFTLTISRLEPEDFAVYYCQQYGSSPWTFGQGTKVEIK

SEQ ID NO: 33 - protein, 5 aa, Artificial Sequence
  Description of Artificial Sequence: Synthetic peptide
  XENP019534 vhCDR1
SYTMH

SEQ ID NO: 34 - protein, 17 aa, Artificial Sequence
  Description of Artificial Sequence: Synthetic peptide
  XENP019534 vhCDR2
FISYDGNNKYYADSVKG

SEQ ID NO: 35 - protein, 9 aa, Artificial Sequence
  Description of Artificial Sequence: Synthetic peptide
  XENP019534 vhCDR3
TGWLGPFDY

SEQ ID NO: 36 - protein, 12 aa, Artificial Sequence
  Description of Artificial Sequence: Synthetic peptide
  XENP019534 vlCDR1
RASQSVGSSYLA

SEQ ID NO: 37 - protein, 7 aa, Artificial Sequence
  Description of Artificial Sequence: Synthetic peptide
  XENP019534 vlCDR2
GAFSRAT

SEQ ID NO: 38 - protein, 9 aa, Artificial Sequence
  Description of Artificial Sequence: Synthetic peptide
  XENP019534 vlCDR3
QQYGSSPWT

SEQ ID NO: 39 - protein, 246 aa, Artificial Sequence
  Description of Artificial Sequence: Synthetic polypeptide
  XENP019535 [CTLA-4]_H0.36_L0.51_scFv(GKPGS)4
QVQLVESGGGVVQPGRSLRLSCAASGFTFSSYTMHWVRKAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPDQAPRLLIYGAFSRATGIPDRFSGSGSGTDFTLTISRLEPEDFAVYYCQQYGSSPWTFGQGTKVEIK

SEQ ID NO: 40 - protein, 118 aa, Artificial Sequence; identical to SEQ ID NO: 31
  Description of Artificial Sequence: Synthetic polypeptide
  VH of XENP019535

SEQ ID NO: 41 - protein, 108 aa, Artificial Sequence
  Description of Artificial Sequence: Synthetic polypeptide
  VL of XENP019535
EIVLTQSPGTLSLSPGERATLSCRASQSVGSSYLAWYQQKPDQAPRLLIYGAFSRATGIPDRFSGSGSGTDFTLTISRLEPEDFAVYYCQQYGSSPWTFGQGTKVEIK

SEQ ID NO: 42 - protein, 5 aa, Artificial Sequence
  Description of Artificial Sequence: Synthetic peptide
  XENP019535 vhCDR1
SYTMH

SEQ ID NO: 43 - protein, 17 aa, Artificial Sequence
  Description of Artificial Sequence: Synthetic peptide
  XENP019535 vhCDR2
FISYDGNNKYYADSVKG

SEQ ID NO: 44 - protein, 9 aa, Artificial Sequence
  Description of Artificial Sequence: Synthetic peptide
  XENP019535 vhCDR3
TGWLGPFDY

SEQ ID NO: 45 - protein, 12 aa, Artificial Sequence
  Description of Artificial Sequence: Synthetic peptide
  XENP019535 vlCDR1
RASQSVGSSYLA

SEQ ID NO: 46 - protein, 7 aa, Artificial Sequence
  Description of Artificial Sequence: Synthetic peptide
  XENP019535 vlCDR2
GAFSRAT

SEQ ID NO: 47 - protein, 9 aa, Artificial Sequence
  Description of Artificial Sequence: Synthetic peptide
  XENP019535 vlCDR3
QQYGSSPWT

SEQ ID NO: 48 - protein, 246 aa, Artificial Sequence
  Description of Artificial Sequence: Synthetic polypeptide
  XENP019536 [CTLA-4]_H0.37_L0.50_scFv(GKPGS)4
QVQLVESGGGVVQPGRSLRLSCAASGFTFSSYTMHWVRQAPGKRLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQEKPGQAPRLLIYGAFSRATGIPDRFSGSGSGTDFTLTISRLEPEDFAVYYCQQYGSSPWTFGQGTKVEIK

SEQ ID NO: 49 - protein, 118 aa, Artificial Sequence
  Description of Artificial Sequence: Synthetic polypeptide
  VH of XENP019536
QVQLVESGGGVVQPGRSLRLSCAASGFTFSSYTMHWVRQAPGKRLEWVTFISYDGNNKYYADSVKGRFTISRDNSKNTLYLQMNSLRAEDTAIYYCARTGWLGPFDYWGQGTLVTVSS

SEQ ID NO: 50 - protein, 108 aa, Artificial Sequence; identical to SEQ ID NO: 32
  Description of Artificial Sequence: Synthetic polypeptide
  VL of XENP019536

SEQ ID NO: 51 - protein, 5 aa, Artificial Sequence
  Description of Artificial Sequence: Synthetic peptide
  XENP019536 vhCDR1
SYTMH

SEQ ID NO: 52 - protein, 17 aa, Artificial Sequence
  Description of Artificial Sequence: Synthetic peptide
  XENP019536 vhCDR2
FISYDGNNKYYADSVKG

SEQ ID NO: 53 - protein, 9 aa, Artificial Sequence
  Description of Artificial Sequence: Synthetic peptide
  XENP019536 vhCDR3
TGWLGPFDY

SEQ ID NO: 54 - protein, 12 aa, Artificial Sequence
  Description of Artificial Sequence: Synthetic peptide
  XENP019536 vlCDR1
RASQSVGSSYLA

SEQ ID NO: 55 - protein, 7 aa, Artificial Sequence
  Description of Artificial Sequence: Synthetic peptide
  XENP019536 vlCDR2
GAFSRAT

SEQ ID NO: 56 - protein, 9 aa, Artificial Sequence
  Description of Artificial Sequence: Synthetic peptide
  XENP019536 vlCDR3
QQYGSSPWT

SEQ ID NO: 57 - protein, 246 aa, Artificial Sequence
  Description of Artificial Sequence: Synthetic polypeptide
  XENP019537 [CTLA-4]_H0.37_L0.113_scFv(GKPGS)4
QVQLVESGGGVVQPGRSLRLSCAASGFTFSSYTMHWVRQAPGKRLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGEGTKVEIK

SEQ ID NO: 58 - protein, 118 aa, Artificial Sequence; identical to SEQ ID NO: 49
  Description of Artificial Sequence: Synthetic polypeptide
  VH of XENP019537

SEQ ID NO: 59 - protein, 108 aa, Artificial Sequence
  Description of Artificial Sequence: Synthetic polypeptide
  VL of XENP019537
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGEGTKVEIK

SEQ ID NO: 60 - protein, 5 aa, Artificial Sequence
  Description of Artificial Sequence: Synthetic peptide
  XENP019537 vhCDR1
SYTMH

SEQ ID NO: 61 - protein, 17 aa, Artificial Sequence
  Description of Artificial Sequence: Synthetic peptide
  XENP019537 vhCDR2
FISYDGNNKYYADSVKG

SEQ ID NO: 62 - protein, 9 aa, Artificial Sequence
  Description of Artificial Sequence: Synthetic peptide
  XENP019537 vhCDR3
TGWLGPFDY

SEQ ID NO: 63 - protein, 12 aa, Artificial Sequence
  Description of Artificial Sequence: Synthetic peptide
  XENP019537 vlCDR1
RASQSVGSSYLA

SEQ ID NO: 64 - protein, 7 aa, Artificial Sequence
  Description of Artificial Sequence: Synthetic peptide
  XENP019537 vlCDR2
GAFSRAT

SEQ ID NO: 65 - protein, 9 aa, Artificial Sequence
  Description of Artificial Sequence: Synthetic peptide
  XENP019537 vlCDR3
QQYGSSPWT

SEQ ID NO: 66 - protein, 246 aa, Artificial Sequence
  Description of Artificial Sequence: Synthetic polypeptide
  XENP019538 [CTLA-4]_H0.134_L0.51_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGRGTLVTVSSGKPGSGKPGSGKPGSGKPGSEIVLTQSPGTLSLSPGERATLSCRASQSVGSSYLAWYQQKPDQAPRLLIYGAFSRATGIPDRFSGSGSGTDFTLTISRLEPEDFAVYYCQQYGSSPWTFGQGTKVEIK

SEQ ID NO: 67 - protein, 118 aa, Artificial Sequence
  Description of Artificial Sequence: Synthetic polypeptide
  VH of XENP019538
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGRGTLVTVSS

SEQ ID NO: 68 - protein, 108 aa, Artificial Sequence; identical to SEQ ID NO: 41
  Description of Artificial Sequence: Synthetic polypeptide
  VL of XENP019538

SEQ ID NO: 69 - protein, 5 aa, Artificial Sequence
  Description of Artificial Sequence: Synthetic peptide
  XENP019538 vhCDR1
SYTMH

SEQ ID NO: 70 - protein, 17 aa, Artificial Sequence
  Description of Artificial Sequence: Synthetic peptide
  XENP019538 vhCDR2
FISYDGNNKYYADSVKG

SEQ ID NO: 71 - protein, 9 aa, Artificial Sequence
  Description of Artificial Sequence: Synthetic peptide
  XENP019538 vhCDR3
TGWLGPFDY

SEQ ID NO: 72 - protein, 12 aa, Artificial Sequence
  Description of Artificial Sequence: Synthetic peptide
  XENP019538 vlCDR1
RASQSVGSSYLA

SEQ ID NO: 73 - protein, 7 aa, Artificial Sequence
  Description of Artificial Sequence: Synthetic peptide
  XENP019538 vlCDR2
GAFSRAT

SEQ ID NO: 74 - protein, 9 aa, Artificial Sequence
  Description of Artificial Sequence: Synthetic peptide
  XENP019538 vlCDR3
QQYGSSPWT

SEQ ID NO: 75 - protein, 246 aa, Artificial Sequence
  Description of Artificial Sequence: Synthetic polypeptide
  XENP019539 [CTLA-4]_H0.134_L0.53_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGRGTLVTVSSGKPGSGKPGSGKPGSGKPGSEIVLTQSPGTLSLSPGERATLSCRASQSVGSSYLAWYQQKPGEAPRLLIYGAFSRATGIPDRFSGSGSGTDFTLTISRLEPEDFAVYYCQQYGSSPWTFGQGTKVEIK

SEQ ID NO: 76 - protein, 118 aa, Artificial Sequence; identical to SEQ ID NO: 67
  Description of Artificial Sequence: Synthetic polypeptide
  VH of XENP019539

SEQ ID NO: 77 - protein, 108 aa, Artificial Sequence
  Description of Artificial Sequence: Synthetic polypeptide
  VL of XENP019539
EIVLTQSPGTLSLSPGERATLSCRASQSVGSSYLAWYQQKPGEAPRLLIYGAFSRATGIPDRFSGSGSGTDFTLTISRLEPEDFAVYYCQQYGSSPWTFGQGTKVEIK

SEQ ID NO: 78 - protein, 5 aa, Artificial Sequence
  Description of Artificial Sequence: Synthetic peptide
  XENP019539 vhCDR1
SYTMH

SEQ ID NO: 79 - protein, 17 aa, Artificial Sequence
  Description of Artificial Sequence: Synthetic peptide
  XENP019539 vhCDR2
FISYDGNNKYYADSVKG

SEQ ID NO: 80 - protein, 9 aa, Artificial Sequence
  Description of Artificial Sequence: Synthetic peptide
  XENP019539 vhCDR3
TGWLGPFDY

SEQ ID NO: 81 - protein, 12 aa, Artificial Sequence
  Description of Artificial Sequence: Synthetic peptide
  XENP019539 vlCDR1
RASQSVGSSYLA

SEQ ID NO: 82 - protein, 7 aa, Artificial Sequence
  Description of Artificial Sequence: Synthetic peptide
  XENP019539 vlCDR2
GAFSRAT

SEQ ID NO: 83 - protein, 9 aa, Artificial Sequence
  Description of Artificial Sequence: Synthetic peptide
  XENP019539 vlCDR3
QQYGSSPWT

SEQ ID NO: 84 - protein, 246 aa, Artificial Sequence
  Description of Artificial Sequence: Synthetic polypeptide
  XENP019540 [CTLA-4]_H0.134_L0.57_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGRGTLVTVSSGKPGSGKPGSGKPGSGKPGSEIVLTQSPGTLSLSPGERATLSCRASQSVGSSYLAWYQQKPGQAPELLIYGAFSRATGIPDRFSGSGSGTDFTLTISRLEPEDFAVYYCQQYGSSPWTFGQGTKVEIK

SEQ ID NO: 85 - protein, 118 aa, Artificial Sequence; identical to SEQ ID NO: 67
  Description of Artificial Sequence: Synthetic polypeptide
  VH of XENP019540

SEQ ID NO: 86 - protein, 108 aa, Artificial Sequence
  Description of Artificial Sequence: Synthetic polypeptide
  VL of XENP019540
EIVLTQSPGTLSLSPGERATLSCRASQSVGSSYLAWYQQKPGQAPELLIYGAFSRATGIPDRFSGSGSGTDFTLTISRLEPEDFAVYYCQQYGSSPWTFGQGTKVEIK

SEQ ID NO: 87 - protein, 5 aa, Artificial Sequence
  Description of Artificial Sequence: Synthetic peptide
  XENP019540 vhCDR1
SYTMH

SEQ ID NO: 88 - protein, 17 aa, Artificial Sequence
  Description of Artificial Sequence: Synthetic peptide
  XENP019540 vhCDR2
FISYDGNNKYYADSVKG

SEQ ID NO: 89 - protein, 9 aa, Artificial Sequence
  Description of Artificial Sequence: Synthetic peptide
  XENP019540 vhCDR3
TGWLGPFDY

SEQ ID NO: 90 - protein, 12 aa, Artificial Sequence
  Description of Artificial Sequence: Synthetic peptide
  XENP019540 vlCDR1
RASQSVGSSYLA

SEQ ID NO: 91 - protein, 7 aa, Artificial Sequence
  Description of Artificial Sequence: Synthetic peptide
  XENP019540 vlCDR2
GAFSRAT

SEQ ID NO: 92 - protein, 9 aa, Artificial Sequence
  Description of Artificial Sequence: Synthetic peptide
  XENP019540 vlCDR3
QQYGSSPWT

SEQ ID NO: 93 - protein, 246 aa, Artificial Sequence
  Description of Artificial Sequence: Synthetic polypeptide
  XENP019541 [CTLA-4]_H0.137_L0.114_scFv(GKPGS)4
QVQLVESGGGVVQPGRSLRLSCAASGFTFSSYTMHWVRQAPGKCLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGCGTKVEIK

SEQ ID NO: 94 - protein, 118 aa, Artificial Sequence
  Description of Artificial Sequence: Synthetic polypeptide
  VH of XENP019541
QVQLVESGGGVVQPGRSLRLSCAASGFTFSSYTMHWVRQAPGKCLEWVTFISYDGNNKYYADSVKGRFTISRDNSKNTLYLQMNSLRAEDTAIYYCARTGWLGPFDYWGQGTLVTVSS

SEQ ID NO: 95 - protein, 108 aa, Artificial Sequence
  Description of Artificial Sequence: Synthetic polypeptide
  VL of XENP019541
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGCGTKVEIK

SEQ ID NO: 96 - protein, 5 aa, Artificial Sequence
  Description of Artificial Sequence: Synthetic peptide
  XENP019541 vhCDR1
SYTMH

SEQ ID NO: 97 - protein, 17 aa, Artificial Sequence
  Description of Artificial Sequence: Synthetic peptide
  XENP019541 vhCDR2
FISYDGNNKYYADSVKG

SEQ ID NO: 98 - protein, 9 aa, Artificial Sequence
  Description of Artificial Sequence: Synthetic peptide
  XENP019541 vhCDR3
TGWLGPFDY

SEQ ID NO: 99 - protein, 12 aa, Artificial Sequence
  Description of Artificial Sequence: Synthetic peptide
  XENP019541 vlCDR1
RASQSVGSSYLA

SEQ ID NO: 100 - protein, 7 aa, Artificial Sequence
  Description of Artificial Sequence: Synthetic peptide
  XENP019541 vlCDR2
GAFSRAT

SEQ ID NO: 101 - protein, 9 aa, Artificial Sequence
  Description of Artificial Sequence: Synthetic peptide
  XENP019541 vlCDR3
QQYGSSPWT

SEQ ID NO: 102 - protein, 246 aa, Artificial Sequence
  Description of Artificial Sequence: Synthetic polypeptide
  XENP019542 [CTLA-4]_H0.138_L0.115_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGCGTLVTVSSGKPGSGKPGSGKPGSGKPGSEIVLTQSPGTLSLSPGERATLSCRASQSVGSSYLAWYQQKPCQAPRLLIYGAFSRATGIPDRFSGSGSGTDFTLTISRLEPEDFAVYYCQQYGSSPWTFGQGTKVEIK

SEQ ID NO: 103 - protein, 118 aa, Artificial Sequence
  Description of Artificial Sequence: Synthetic polypeptide
  VH of XENP019542
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGCGTLVTVSS

SEQ ID NO: 104 - protein, 108 aa, Artificial Sequence
  Description of Artificial Sequence: Synthetic polypeptide
  VL of XENP019542
EIVLTQSPGTLSLSPGERATLSCRASQSVGSSYLAWYQQKPCQAPRLLIYGAFSRATGIPDRFSGSGSGTDFTLTISRLEPEDFAVYYCQQYGSSPWTFGQGTKVEIK

SEQ ID NO: 105 - protein, 5 aa, Artificial Sequence
  Description of Artificial Sequence: Synthetic peptide
  XENP019542 vhCDR1
SYTMH

SEQ ID NO: 106 - protein, 17 aa, Artificial Sequence
  Description of Artificial Sequence: Synthetic peptide
  XENP019542 vhCDR2
FISYDGNNKYYADSVKG

SEQ ID NO: 107 - protein, 9 aa, Artificial Sequence
  Description of Artificial Sequence: Synthetic peptide
  XENP019542 vhCDR3
TGWLGPFDY

SEQ ID NO: 108 - protein, 12 aa, Artificial Sequence
  Description of Artificial Sequence: Synthetic peptide
  XENP019542 vlCDR1
RASQSVGSSYLA

SEQ ID NO: 109 - protein, 7 aa, Artificial Sequence
  Description of Artificial Sequence: Synthetic peptide
  XENP019542 vlCDR2
GAFSRAT

SEQ ID NO: 110 - protein, 9 aa, Artificial Sequence
  Description of Artificial Sequence: Synthetic peptide
  XENP019542 vlCDR3
QQYGSSPWT

SEQ ID NO: 111 - protein, 246 aa, Artificial Sequence
  Description of Artificial Sequence: Synthetic polypeptide
  XENP019543 [CTLA-4]_H0.139_L0.116_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGCGTLVTVSSGKPGSGKPGSGKPGSGKPGSEIVLTQSPGTLSLSPGERATLSCRASQSVGSSYLAWYQQKPGCAPRLLIYGAFSRATGIPDRFSGSGSGTDFTLTISRLEPEDFAVYYCQQYGSSPWTFGQGTKVEIK

SEQ ID NO: 112 - protein, 118 aa, Artificial Sequence; identical to SEQ ID NO: 103
  Description of Artificial Sequence: Synthetic polypeptide
  VH of XENP019543

SEQ ID NO: 113 - protein, 108 aa, Artificial Sequence
  Description of Artificial Sequence: Synthetic polypeptide
  VL of XENP019543
EIVLTQSPGTLSLSPGERATLSCRASQSVGSSYLAWYQQKPGCAPRLLIYGAFSRATGIPDRFSGSGSGTDFTLTISRLEPEDFAVYYCQQYGSSPWTFGQGTKVEIK

SEQ ID NO: 114 - protein, 5 aa, Artificial Sequence
  Description of Artificial Sequence: Synthetic peptide
  XENP019543 vhCDR1
SYTMH

SEQ ID NO: 115 - protein, 17 aa, Artificial Sequence
  Description of Artificial Sequence: Synthetic peptide
  XENP019543 vhCDR2
FISYDGNNKYYADSVKG

SEQ ID NO: 116 - protein, 9 aa, Artificial Sequence
  Description of Artificial Sequence: Synthetic peptide
  XENP019543 vhCDR3
TGWLGPFDY

SEQ ID NO: 117 - protein, 12 aa, Artificial Sequence
  Description of Artificial Sequence: Synthetic peptide
  XENP019543 vlCDR1
RASQSVGSSYLA

SEQ ID NO: 118 - protein, 7 aa, Artificial Sequence
  Description of Artificial Sequence: Synthetic peptide
  XENP019543 vlCDR2
GAFSRAT

SEQ ID NO: 119 - protein, 9 aa, Artificial Sequence
  Description of Artificial Sequence: Synthetic peptide
  XENP019543 vlCDR3
QQYGSSPWT

SEQ ID NO: 120 - protein, 246 aa, Artificial Sequence
  Description of Artificial Sequence: Synthetic polypeptide
  XENP019551 [CTLA-4]_H1_L0_scFv(GKPGS)4
EVQLVESGGGLVQPGGSLRLSCAASGFTFSSYTMHWVRQAPGKGLEWVTFISYDGNNKYYVDSVKGRFTISRDNAKNSLYLQMNSLRAEDTAVYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 121 - protein, 118 aa, Artificial Sequence
  Description of Artificial Sequence: Synthetic polypeptide
  VH of XENP019551
EVQLVESGGGLVQPGGSLRLSCAASGFTFSSYTMHWVRQAPGKGLEWVTFISYDGNNKYYVDSVKGRFTISRDNAKNSLYLQMNSLRAEDTAVYYCARTGWLGPFDYWGQGTLVTVSS

SEQ ID NO: 122 - protein, 108 aa, Artificial Sequence; identical to SEQ ID NO: 23
  Description of Artificial Sequence: Synthetic polypeptide
  VL of XENP019551

SEQ ID NO: 123 - protein, 5 aa, Artificial Sequence
  Description of Artificial Sequence: Synthetic peptide
  XENP019551 vhCDR1
SYTMH

SEQ ID NO: 124 - protein, 17 aa, Artificial Sequence
  Description of Artificial Sequence: Synthetic peptide
  XENP019551 vhCDR2
FISYDGNNKYYVDSVKG

SEQ ID NO: 125 - protein, 9 aa, Artificial Sequence
  Description of Artificial Sequence: Synthetic peptide
  XENP019551 vhCDR3
TGWLGPFDY

SEQ ID NO: 126 - protein, 12 aa, Artificial Sequence
  Description of Artificial Sequence: Synthetic peptide
  XENP019551 vlCDR1
RASQSVGSSYLA

SEQ ID NO: 127 - protein, 7 aa, Artificial Sequence
  Description of Artificial Sequence: Synthetic peptide
  XENP019551 vlCDR2
GAFSRAT

SEQ ID NO: 128 - protein, 9 aa, Artificial Sequence
  Description of Artificial Sequence: Synthetic peptide
  XENP019551 vlCDR3
QQYGSSPWT

SEQ ID NO: 129 - protein, 246 aa, Artificial Sequence
  Description of Artificial Sequence: Synthetic polypeptide
  XENP019552 [CTLA-4]_H2_L0_scFv(GKPGS)4
EVQLVESGGGLVQPGGSLRLSCAASGFTFSSYTMHWVRQAPGKGLEWVTFISYDGNNKYYPGSVKGRFTISRENAKNSLYLQMNSLRAGDTAVYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 130 - protein, 118 aa, Artificial Sequence
  Description of Artificial Sequence: Synthetic polypeptide
  VH of XENP019552
EVQLVESGGGLVQPGGSLRLSCAASGFTFSSYTMHWVRQAPGKGLEWVTFISYDGNNKYYPGSVKGRFTISRENAKNSLYLQMNSLRAGDTAVYYCARTGWLGPFDYWGQGTLVTVSS

SEQ ID NO: 131 - protein, 108 aa, Artificial Sequence; identical to SEQ ID NO: 23
  Description of Artificial Sequence: Synthetic polypeptide
  VL of XENP019552

SEQ ID NO: 132 - protein, 5 aa, Artificial Sequence
  Description of Artificial Sequence: Synthetic peptide
  XENP019552 vhCDR1
SYTMH

SEQ ID NO: 133 - protein, 17 aa, Artificial Sequence
  Description of Artificial Sequence: Synthetic peptide
  XENP019552 vhCDR2
FISYDGNNKYYPGSVKG

SEQ ID NO: 134 - protein, 9 aa, Artificial Sequence
  Description of Artificial Sequence: Synthetic peptide
  XENP019552 vhCDR3
TGWLGPFDY

SEQ ID NO: 135 - protein, 12 aa, Artificial Sequence
  Description of Artificial Sequence: Synthetic peptide
  XENP019552 vlCDR1
RASQSVGSSYLA

SEQ ID NO: 136 - protein, 7 aa, Artificial Sequence
  Description of Artificial Sequence: Synthetic peptide
  XENP019552 vlCDR2
GAFSRAT

SEQ ID NO: 137 - protein, 9 aa, Artificial Sequence
  Description of Artificial Sequence: Synthetic peptide
  XENP019552 vlCDR3
QQYGSSPWT

SEQ ID NO: 138 - protein, 246 aa, Artificial Sequence
  Description of Artificial Sequence: Synthetic polypeptide
  XENP019553 [CTLA-4]_H3_L0_scFv(GKPGS)4
EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 139 - protein, 118 aa, Artificial Sequence
  Description of Artificial Sequence: Synthetic polypeptide
  VH of XENP019553
EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGWLGPFDYWGQGTLVTVSS

SEQ ID NO: 140 - protein, 108 aa, Artificial Sequence; identical to SEQ ID NO: 23
  Description of Artificial Sequence: Synthetic polypeptide
  VL of XENP019553

SEQ ID NO: 141 - protein, 5 aa, Artificial Sequence
  Description of Artificial Sequence: Synthetic peptide
  XENP019553 vhCDR1
SYTMH

SEQ ID NO: 142 - protein, 17 aa, Artificial Sequence
  Description of Artificial Sequence: Synthetic peptide
  XENP019553 vhCDR2
FISYDGNNKYYADSVKG

SEQ ID NO: 143 - protein, 9 aa, Artificial Sequence
  Description of Artificial Sequence: Synthetic peptide
  XENP019553 vhCDR3
TGWLGPFDY

SEQ ID NO: 144 - protein, 12 aa, Artificial Sequence
  Description of Artificial Sequence: Synthetic peptide
  XENP019553 vlCDR1
RASQSVGSSYLA

SEQ ID NO: 145 - protein, 7 aa, Artificial Sequence
  Description of Artificial Sequence: Synthetic peptide
  XENP019553 vlCDR2
GAFSRAT

SEQ ID NO: 146 - protein, 9 aa, Artificial Sequence
  Description of Artificial Sequence: Synthetic peptide
  XENP019553 vlCDR3
QQYGSSPWT

SEQ ID NO: 147 - protein, 246 aa, Artificial Sequence
  Description of Artificial Sequence: Synthetic polypeptide
  XENP019554 [CTLA-4]_H4_L0_scFv(GKPGS)4
EVQLVESGGGLVQPGGSLRLSCAASGFTFSSYTMHWVRQAPGKGLEYVTFISYDGNNKYYADSVKGRFTISRDNSKNTLYLQMGSLRAEDMAVYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 148 - protein, 118 aa, Artificial Sequence
  Description of Artificial Sequence: Synthetic polypeptide
  VH of XENP019554
EVQLVESGGGLVQPGGSLRLSCAASGFTFSSYTMHWVRQAPGKGLEYVTFISYDGNNKYYADSVKGRFTISRDNSKNTLYLQMGSLRAEDMAVYYCARTGWLGPFDYWGQGTLVTVSS

SEQ ID NO: 149 - protein, 108 aa, Artificial Sequence; identical to SEQ ID NO: 23
  Description of Artificial Sequence: Synthetic polypeptide
  VL of XENP019554

SEQ ID NO: 150 - protein, 5 aa, Artificial Sequence
  Description of Artificial Sequence: Synthetic peptide
  XENP019554 vhCDR1
SYTMH

SEQ ID NO: 151 - protein, 17 aa, Artificial Sequence
  Description of Artificial Sequence: Synthetic peptide
  XENP019554 vhCDR2
FISYDGNNKYYADSVKG

SEQ ID NO: 152 - protein, 9 aa, Artificial Sequence
  Description of Artificial Sequence: Synthetic peptide
  XENP019554 vhCDR3
TGWLGPFDY

SEQ ID NO: 153 - protein, 12 aa, Artificial Sequence
  Description of Artificial Sequence: Synthetic peptide
  XENP019554 vlCDR1
RASQSVGSSYLA

SEQ ID NO: 154 - protein, 7 aa, Artificial Sequence
  Description of Artificial Sequence: Synthetic peptide
  XENP019554 vlCDR2
GAFSRAT

SEQ ID NO: 155 - protein, 9 aa, Artificial Sequence
  Description of Artificial Sequence: Synthetic peptide
  XENP019554 vlCDR3
QQYGSSPWT

SEQ ID NO: 156 - protein, 246 aa, Artificial Sequence
  Description of Artificial Sequence: Synthetic polypeptide
  XENP019555 [CTLA-4]_H0_L1_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPATLSLSPGERATLSCGASQSVGSSYLAWYQQKPGLAPRLLIYGAFSRATGIPDRFSGSGSGTDFTLTISRLEPEDFAVYYCQQYGSSPWTFGQGTKVEIK

SEQ ID NO: 157 - protein, 118 aa, Artificial Sequence; identical to SEQ ID NO: 22
  Description of Artificial Sequence: Synthetic polypeptide
  VH of XENP019555

SEQ ID NO: 158 - protein, 108 aa, Artificial Sequence
  Description of Artificial Sequence: Synthetic polypeptide
  VL of XENP019555
EIVLTQSPATLSLSPGERATLSCGASQSVGSSYLAWYQQKPGLAPRLLIYGAFSRATGIPDRFSGSGSGTDFTLTISRLEPEDFAVYYCQQYGSSPWTFGQGTKVEIK

SEQ ID NO: 159 - protein, 5 aa, Artificial Sequence
  Description of Artificial Sequence: Synthetic peptide
  XENP019555 vhCDR1
SYTMH

SEQ ID NO: 160 - protein, 17 aa, Artificial Sequence
  Description of Artificial Sequence: Synthetic peptide
  XENP019555 vhCDR2
FISYDGNNKYYADSVKG

SEQ ID NO: 161 - protein, 9 aa, Artificial Sequence
  Description of Artificial Sequence: Synthetic peptide
  XENP019555 vhCDR3
TGWLGPFDY

SEQ ID NO: 162 - protein, 12 aa, Artificial Sequence
  Description of Artificial Sequence: Synthetic peptide
  XENP019555 vlCDR1
GASQSVGSSYLA

SEQ ID NO: 163 - protein, 7 aa, Artificial Sequence
  Description of Artificial Sequence: Synthetic peptide
  XENP019555 vlCDR2
GAFSRAT

SEQ ID NO: 164 - protein, 9 aa, Artificial Sequence
  Description of Artificial Sequence: Synthetic peptide
  XENP019555 vlCDR3
QQYGSSPWT

SEQ ID NO: 165 - protein, 246 aa, Artificial Sequence
  Description of Artificial Sequence: Synthetic polypeptide
  XENP019556 [CTLA-4]_H0_L2_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVMTQSPATLSVSPGERATLSCRASQSVGSSYLAWYQQKPGQAPRLLIYGAFSRATGIPARFSGSGSGTEFTLTISSLQSEDFAVYYCQQYGSSPWTFGQGTKVEIK

SEQ ID NO: 166 - protein, 118 aa, Artificial Sequence; identical to SEQ ID NO: 22
  Description of Artificial Sequence: Synthetic polypeptide
  VH of XENP019556

SEQ ID NO: 167 - protein, 108 aa, Artificial Sequence
  Description of Artificial Sequence: Synthetic polypeptide
  VL of XENP019556
EIVMTQSPATLSVSPGERATLSCRASQSVGSSYLAWYQQKPGQAPRLLIYGAFSRATGIPARFSGSGSGTEFTLTISSLQSEDFAVYYCQQYGSSPWTFGQGTKVEIK

SEQ ID NO: 168 - protein, 5 aa, Artificial Sequence
  Description of Artificial Sequence: Synthetic peptide
  XENP019556 vhCDR1
SYTMH

SEQ ID NO: 169 - protein, 17 aa, Artificial Sequence
  Description of Artificial Sequence: Synthetic peptide
  XENP019556 vhCDR2
FISYDGNNKYYADSVKG

SEQ ID NO: 170 - protein, 9 aa, Artificial Sequence
  Description of Artificial Sequence: Synthetic peptide
  XENP019556 vhCDR3
TGWLGPFDY

SEQ ID NO: 171 - protein, 12 aa, Artificial Sequence
  Description of Artificial Sequence: Synthetic peptide
  XENP019556 vlCDR1
RASQSVGSSYLA

SEQ ID NO: 172 - protein, 7 aa, Artificial Sequence
  Description of Artificial Sequence: Synthetic peptide
  XENP019556 vlCDR2
GAFSRAT

SEQ ID NO: 173 - protein, 9 aa, Artificial Sequence
  Description of Artificial Sequence: Synthetic peptide
  XENP019556 vlCDR3
QQYGSSPWT

SEQ ID NO: 174 - protein, 246 aa, Artificial Sequence
  Description of Artificial Sequence: Synthetic polypeptide
  XENP019587 [CTLA-4]_H0.140_L0_scFv(GKPGS)4
QVQLVESGGGVVQPGRSLRLSCAASGFTFSSYTMHWVRQAPGKGLEWVCFISYDGNNKYYADSVKGRFTCSRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 175 - protein, 118 aa, Artificial Sequence
  Description of Artificial Sequence: Synthetic polypeptide
  VH of XENP019587
QVQLVESGGGVVQPGRSLRLSCAASGFTFSSYTMHWVRQAPGKGLEWVCFISYDGNNKYYADSVKGRFTCSRDNSKNTLYLQMNSLRAEDTAIYYCARTGWLGPFDYWGQGTLVTVSS

SEQ ID NO: 176 - protein, 108 aa, Artificial Sequence; identical to SEQ ID NO: 23
  Description of Artificial Sequence: Synthetic polypeptide
  VL of XENP019587

SEQ ID NO: 177 - protein, 5 aa, Artificial Sequence
  Description of Artificial Sequence: Synthetic peptide
  XENP019587 vhCDR1
SYTMH

SEQ ID NO: 178 - protein, 17 aa, Artificial Sequence
  Description of Artificial Sequence: Synthetic peptide
  XENP019587 vhCDR2
FISYDGNNKYYADSVKG

SEQ ID NO: 179 - protein, 9 aa, Artificial Sequence
  Description of Artificial Sequence: Synthetic peptide
  XENP019587 vhCDR3
TGWLGPFDY

SEQ ID NO: 180 - protein, 12 aa, Artificial Sequence
  Description of Artificial Sequence: Synthetic peptide
  XENP019587 vlCDR1
RASQSVGSSYLA

SEQ ID NO: 181 - protein, 7 aa, Artificial Sequence
  Description of Artificial Sequence: Synthetic peptide
  XENP019587 vlCDR2
GAFSRAT

SEQ ID NO: 182 - protein, 9 aa, Artificial Sequence
  Description of Artificial Sequence: Synthetic peptide
  XENP019587 vlCDR3
QQYGSSPWT

SEQ ID NO: 183 - protein, 246 aa, Artificial Sequence
  Description of Artificial Sequence: Synthetic polypeptide
  XENP019588 [CTLA-4]_H0_L0.117_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLCYGAFSRATGIPDRFSCSGSGTDFTLTISRLEPEDFAVYYCQQYGSSPWTFGQGTKVEIK

SEQ ID NO: 184 - protein, 118 aa, Artificial Sequence; identical to SEQ ID NO: 22
  Description of Artificial Sequence: Synthetic polypeptide
  VH of XENP019588

SEQ ID NO: 185 - protein, 108 aa, Artificial Sequence
  Description of Artificial Sequence: Synthetic polypeptide
  VL of XENP019588
EIVLTQSPGTLSLSPGERATLSCRASQSVGSSYLAWYQQKPGQAPRLLCYGAFSRATGIPDRFSCSGSGTDFTLTISRLEPEDFAVYYCQQYGSSPWTFGQGTKVEIK

SEQ ID NO: 186 - protein, 5 aa, Artificial Sequence
  Description of Artificial Sequence: Synthetic peptide
  XENP019588 vhCDR1
SYTMH

SEQ ID NO: 187 - protein, 17 aa, Artificial Sequence
  Description of Artificial Sequence: Synthetic peptide
  XENP019588 vhCDR2
FISYDGNNKYYADSVKG

SEQ ID NO: 188 - protein, 9 aa, Artificial Sequence
  Description of Artificial Sequence: Synthetic peptide
  XENP019588 vhCDR3
TGWLGPFDY

SEQ ID NO: 189 - protein, 12 aa, Artificial Sequence
  Description of Artificial Sequence: Synthetic peptide
  XENP019588 vlCDR1
RASQSVGSSYLA

SEQ ID NO: 190 - protein, 7 aa, Artificial Sequence
  Description of Artificial Sequence: Synthetic peptide
  XENP019588 vlCDR2
GAFSRAT

SEQ ID NO: 191 - protein, 9 aa, Artificial Sequence
  Description of Artificial Sequence: Synthetic peptide
  XENP019588 vlCDR3
QQYGSSPWT

SEQ ID NO: 192 - protein, 246 aa, Artificial Sequence
  Description of Artificial Sequence: Synthetic polypeptide
  XENP019745 [CTLA-4]_H0.1_L0_scFv(GKPGS)4
EVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 193 - protein, 118 aa, Artificial Sequence
  Description of Artificial Sequence: Synthetic polypeptide
  VH of XENP019745
EVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 194 - protein, 108 aa, Artificial Sequence; identical to SEQ ID NO: 23
  Description of Artificial Sequence: Synthetic polypeptide
  VL of XENP019745

SEQ ID NO: 195 - protein, 5 aa, Artificial Sequence
  Description of Artificial Sequence: Synthetic peptide
  XENP019745 vhCDR1
SYTMH

SEQ ID NO: 196 - protein, 17 aa, Artificial Sequence
  Description of Artificial Sequence: Synthetic peptide
  XENP019745 vhCDR2
FISYDGNNKYYADSVKG

SEQ ID NO: 197 - protein, 9 aa, Artificial Sequence
  Description of Artificial Sequence: Synthetic peptide
  XENP019745 vhCDR3
TGWLGPFDY

SEQ ID NO: 198 - protein, 12 aa, Artificial Sequence
  Description of Artificial Sequence: Synthetic peptide
  XENP019745 vlCDR1
RASQSVGSSYLA

SEQ ID NO: 199 - protein, 7 aa, Artificial Sequence
  Description of Artificial Sequence: Synthetic peptide
  XENP019745 vlCDR2
GAFSRAT

SEQ ID NO: 200 - protein, 9 aa, Artificial Sequence
  Description of Artificial Sequence: Synthetic peptide
  XENP019745 vlCDR3
QQYGSSPWT

SEQ ID NO: 201 - protein, 246 aa, Artificial Sequence
  Description of Artificial Sequence: Synthetic polypeptide
  XENP019746 [CTLA-4]_H0.2_L0_scFv(GKPGS)4
QVQLLESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 202 - protein, 118 aa, Artificial Sequence
  Description of Artificial Sequence: Synthetic polypeptide
  VH of XENP019746
QVQLLESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 203 - protein, 108 aa, Artificial Sequence; identical to SEQ ID NO: 23
  Description of Artificial Sequence: Synthetic polypeptide
  VL of XENP019746

SEQ ID NO: 204 - protein, 5 aa, Artificial Sequence
  Description of Artificial Sequence: Synthetic peptide
  XENP019746 vhCDR1
SYTMH

SEQ ID NO: 205 - protein, 17 aa, Artificial Sequence
  Description of Artificial Sequence: Synthetic peptide
  XENP019746 vhCDR2
FISYDGNNKYYADSVKG

SEQ ID NO: 206 - protein, 9 aa, Artificial Sequence
  Description of Artificial Sequence: Synthetic peptide
  XENP019746 vhCDR3
TGWLGPFDY

SEQ ID NO: 207 - protein, 12 aa, Artificial Sequence
  Description of Artificial Sequence: Synthetic peptide
  XENP019746 vlCDR1
RASQSVGSSYLA

SEQ ID NO: 208 - protein, 7 aa, Artificial Sequence
  Description of Artificial Sequence: Synthetic peptide
  XENP019746 vlCDR2
GAFSRAT

SEQ ID NO: 209 - protein, 9 aa, Artificial Sequence
  Description of Artificial Sequence: Synthetic peptide
  XENP019746 vlCDR3
QQYGSSPWT

SEQ ID NO: 210 - protein, 246 aa, Artificial Sequence
  Description of Artificial Sequence: Synthetic polypeptide
  XENP019747 [CTLA-4]_H0.3_L0_scFv(GKPGS)4
QVQLVESGGGLVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 211 - protein, 118 aa, Artificial Sequence
  Description of Artificial Sequence: Synthetic polypeptide
  VH of XENP019747
QVQLVESGGGLVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 212 - protein, 108 aa, Artificial Sequence; identical to SEQ ID NO: 23
  Description of Artificial Sequence: Synthetic polypeptide
  VL of XENP019747

SEQ ID NO: 213 - protein, 5 aa, Artificial Sequence
  Description of Artificial Sequence: Synthetic peptide
  XENP019747 vhCDR1
SYTMH

SEQ ID NO: 214 - protein, 17 aa, Artificial Sequence
  Description of Artificial Sequence: Synthetic peptide
  XENP019747 vhCDR2
FISYDGNNKYYADSVKG

SEQ ID NO: 215 - protein, 9 aa, Artificial Sequence
  Description of Artificial Sequence: Synthetic peptide
  XENP019747 vhCDR3
TGWLGPFDY

SEQ ID NO: 216 - protein, 12 aa, Artificial Sequence
  Description of Artificial Sequence: Synthetic peptide
  XENP019747 vlCDR1
RASQSVGSSYLA

SEQ ID NO: 217 - protein, 7 aa, Artificial Sequence
  Description of Artificial Sequence: Synthetic peptide
  XENP019747 vlCDR2
GAFSRAT

SEQ ID NO: 218 - protein, 9 aa, Artificial Sequence
  Description of Artificial Sequence: Synthetic peptide
  XENP019747 vlCDR3
QQYGSSPWT

SEQ ID NO: 219 - protein, 246 aa, Artificial Sequence
  Description of Artificial Sequence: Synthetic polypeptide
  XENP019748 [CTLA-4]_H0.4_L0_scFv(GKPGS)4
QVQLVESGGGVKQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 220 - protein, 118 aa, Artificial Sequence
  Description of Artificial Sequence: Synthetic polypeptide
  VH of XENP019748
QVQLVESGGGVKQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 221 - protein, 108 aa, Artificial Sequence; identical to SEQ ID NO: 23
  Description of Artificial Sequence: Synthetic polypeptide
  VL of XENP019748

SEQ ID NO: 222 - protein, 5 aa, Artificial Sequence
  Description of Artificial Sequence: Synthetic peptide
  XENP019748 vhCDR1
SYTMH

SEQ ID NO: 223 - protein, 17 aa, Artificial Sequence
  Description of Artificial Sequence: Synthetic peptide
  XENP019748 vhCDR2
FISYDGNNKYYADSVKG

SEQ ID NO: 224 - protein, 9 aa, Artificial Sequence
  Description of Artificial Sequence: Synthetic peptide
  XENP019748 vhCDR3
TGWLGPFDY

SEQ ID NO: 225 - protein, 12 aa, Artificial Sequence
  Description of Artificial Sequence: Synthetic peptide
  XENP019748 vlCDR1
RASQSVGSSYLA

SEQ ID NO: 226 - protein, 7 aa, Artificial Sequence
  Description of Artificial Sequence: Synthetic peptide
  XENP019748 vlCDR2
GAFSRAT

SEQ ID NO: 227 - protein, 9 aa, Artificial Sequence
  Description of Artificial Sequence: Synthetic peptide
  XENP019748 vlCDR3
QQYGSSPWT

SEQ ID NO: 228 - protein, 246 aa, Artificial Sequence
  Description of Artificial Sequence: Synthetic polypeptide
  XENP019749 [CTLA-4]_H0.5_L0_scFv(GKPGS)4
QVQLVESGGGVKQPGESLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 229 - protein, 118 aa, Artificial Sequence
  Description of Artificial Sequence: Synthetic polypeptide
  VH of XENP019749
QVQLVESGGGVKQPGESLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 230 - protein, 108 aa, Artificial Sequence; identical to SEQ ID NO: 23
  Description of Artificial Sequence: Synthetic polypeptide
  VL of XENP019749

SEQ ID NO: 231 - protein, 5 aa, Artificial Sequence
  Description of Artificial Sequence: Synthetic peptide
  XENP019749 vhCDR1
SYTMH

SEQ ID NO: 232 - protein, 17 aa, Artificial Sequence
  Description of Artificial Sequence: Synthetic peptide
  XENP019749 vhCDR2
FISYDGNNKYYADSVKG

SEQ ID NO: 233 - protein, 9 aa, Artificial Sequence
  Description of Artificial Sequence: Synthetic peptide
  XENP019749 vhCDR3
TGWLGPFDY

SEQ ID NO: 234 - protein, 12 aa, Artificial Sequence
  Description of Artificial Sequence: Synthetic peptide
  XENP019749 vlCDR1
RASQSVGSSYLA

SEQ ID NO: 235 - protein, 7 aa, Artificial Sequence
  Description of Artificial Sequence: Synthetic peptide
  XENP019749 vlCDR2
GAFSRAT

SEQ ID NO: 236 - protein, 9 aa, Artificial Sequence
  Description of Artificial Sequence: Synthetic peptide
  XENP019749 vlCDR3
QQYGSSPWT

SEQ ID NO: 237 - protein, 246 aa, Artificial Sequence
  Description of Artificial Sequence: Synthetic polypeptide
  XENP019750 [CTLA-4]_H0.6_L0_scFv(GKPGS)4
QVQLVESGGGVVKPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 238 - protein, 118 aa, Artificial Sequence
  Description of Artificial Sequence: Synthetic polypeptide
  VH of XENP019750
QVQLVESGGGVVKPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 239 - protein, 108 aa, Artificial Sequence; identical to SEQ ID NO: 23
  Description of Artificial Sequence: Synthetic polypeptide
  VL of XENP019750

SEQ ID NO: 240 - protein, 5 aa, Artificial Sequence
  Description of Artificial Sequence: Synthetic peptide
  XENP019750 vhCDR1
SYTMH

SEQ ID NO: 241 - protein, 17 aa, Artificial Sequence
  Description of Artificial Sequence: Synthetic peptide
  XENP019750 vhCDR2
FISYDGNNKYYADSVKG

SEQ ID NO: 242 - protein, 9 aa, Artificial Sequence
  Description of Artificial Sequence: Synthetic peptide
  XENP019750 vhCDR3
TGWLGPFDY

SEQ ID NO: 243 - protein, 12 aa, Artificial Sequence
  Description of Artificial Sequence: Synthetic peptide
  XENP019750 vlCDR1
RASQSVGSSYLA

SEQ ID NO: 244 - protein, 7 aa, Artificial Sequence
  Description of Artificial Sequence: Synthetic peptide
  XENP019750 vlCDR2
GAFSRAT

SEQ ID NO: 245 - protein, 9 aa, Artificial Sequence
  Description of Artificial Sequence: Synthetic peptide
  XENP019750 vlCDR3
QQYGSSPWT

SEQ ID NO: 246 - protein, 246 aa, Artificial Sequence
  Description of Artificial Sequence: Synthetic polypeptide
  XENP019751 [CTLA-4]_H0.7_L0_scFv(GKPGS)4
QVQLVESGGGVVEPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 247 - protein, 118 aa, Artificial Sequence
  Description of Artificial Sequence: Synthetic polypeptide
  VH of XENP019751
QVQLVESGGGVVEPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 248 - protein, 108 aa, Artificial Sequence; identical to SEQ ID NO: 23
  Description of Artificial Sequence: Synthetic polypeptide
  VL of XENP019751

SEQ ID NO: 249 - protein, 5 aa, Artificial Sequence
  Description of Artificial Sequence: Synthetic peptide
  XENP019751 vhCDR1
SYTMH

SEQ ID NO: 250 - protein, 17 aa, Artificial Sequence
  Description of Artificial Sequence: Synthetic peptide
  XENP019751 vhCDR2
FISYDGNNKYYADSVKG

SEQ ID NO: 251 - protein, 9 aa, Artificial Sequence
  Description of Artificial Sequence: Synthetic peptide
  XENP019751 vhCDR3
TGWLGPFDY

SEQ ID NO: 252 - protein, 12 aa, Artificial Sequence
  Description of Artificial Sequence: Synthetic peptide
  XENP019751 vlCDR1
RASQSVGSSYLA

SEQ ID NO: 253 - protein, 7 aa, Artificial Sequence
  Description of Artificial Sequence: Synthetic peptide
  XENP019751 vlCDR2
GAFSRAT

SEQ ID NO: 254 - protein, 9 aa, Artificial Sequence
  Description of Artificial Sequence: Synthetic peptide
  XENP019751 vlCDR3
QQYGSSPWT

SEQ ID NO: 255 - protein, 246 aa, Artificial Sequence
  Description of Artificial Sequence: Synthetic polypeptide
  XENP019752 [CTLA-4]_H0.8_L0_scFv(GKPGS)4
QVQLVESGGGVVQPGGSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 256 - protein, 118 aa, Artificial Sequence
  Description of Artificial Sequence: Synthetic polypeptide
  VH of XENP019752
QVQLVESGGGVVQPGGSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 257 - protein, 108 aa, Artificial Sequence; identical to SEQ ID NO: 23
  Description of Artificial Sequence: Synthetic polypeptide
  VL of XENP019752

SEQ ID NO: 258 - protein, 5 aa, Artificial Sequence
  Description of Artificial Sequence: Synthetic peptide
  XENP019752 vhCDR1
SYTMH

SEQ ID NO: 259 - protein, 17 aa, Artificial Sequence
  Description of Artificial Sequence: Synthetic peptide
  XENP019752 vhCDR2
FISYDGNNKYYADSVKG

SEQ ID NO: 260 - protein, 9 aa, Artificial Sequence
  Description of Artificial Sequence: Synthetic peptide
  XENP019752 vhCDR3
TGWLGPFDY

SEQ ID NO: 261 - protein, 12 aa, Artificial Sequence
  Description of Artificial Sequence: Synthetic peptide
  XENP019752 vlCDR1
RASQSVGSSYLA

SEQ ID NO: 262 - protein, 7 aa, Artificial Sequence
  Description of Artificial Sequence: Synthetic peptide
  XENP019752 vlCDR2
GAFSRAT

SEQ ID NO: 263 - protein, 9 aa, Artificial Sequence
  Description of Artificial Sequence: Synthetic peptide
  XENP019752 vlCDR3
QQYGSSPWT

SEQ ID NO: 264 - protein, 246 aa, Artificial Sequence
  Description of Artificial Sequence: Synthetic polypeptide
  XENP019753 [CTLA-4]_H0.9_L0_scFv(GKPGS)4
QVQLVESGGGVVQPGESLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 265 - protein, 118 aa, Artificial Sequence
  Description of Artificial Sequence: Synthetic polypeptide
  VH of XENP019753
QVQLVESGGGVVQPGESLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 266 - protein, 108 aa, Artificial Sequence; identical to SEQ ID NO: 23
  Description of Artificial Sequence: Synthetic polypeptide
  VL of XENP019753

SEQ ID NO: 267 - protein, 5 aa, Artificial Sequence
  Description of Artificial Sequence: Synthetic peptide
  XENP019753 vhCDR1
SYTMH

SEQ ID NO: 268 - protein, 17 aa, Artificial Sequence
  Description of Artificial Sequence: Synthetic peptide
  XENP019753 vhCDR2
FISYDGNNKYYADSVKG

SEQ ID NO: 269 - protein, 9 aa, Artificial Sequence
  Description of Artificial Sequence: Synthetic peptide
  XENP019753 vhCDR3
TGWLGPFDY

SEQ ID NO: 270 - protein, 12 aa, Artificial Sequence
  Description of Artificial Sequence: Synthetic peptide
  XENP019753 vlCDR1
RASQSVGSSYLA

SEQ ID NO: 271 - protein, 7 aa, Artificial Sequence
  Description of Artificial Sequence: Synthetic peptide
  XENP019753 vlCDR2
GAFSRAT

SEQ ID NO: 272 - protein, 9 aa, Artificial Sequence
  Description of Artificial Sequence: Synthetic peptide
  XENP019753 vlCDR3
QQYGSSPWT

SEQ ID NO: 273 - protein, 246 aa, Artificial Sequence
  Description of Artificial Sequence: Synthetic polypeptide
  XENP019754 [CTLA-4]_H0.10_L0_scFv(GKPGS)4
QVQLVESGGGVVQPGRSLKLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 274 - protein, 118 aa, Artificial Sequence
  Description of Artificial Sequence: Synthetic polypeptide
  VH of XENP019754
QVQLVESGGGVVQPGRSLKLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 275 - protein, 108 aa, Artificial Sequence; identical to SEQ ID NO: 23
  Description of Artificial Sequence: Synthetic polypeptide
  VL of XENP019754

SEQ ID NO: 276 - protein, 5 aa, Artificial Sequence
  Description of Artificial Sequence: Synthetic peptide
  XENP019754 vhCDR1
SYTMH

SEQ ID NO: 277 - protein, 17 aa, Artificial Sequence
  Description of Artificial Sequence: Synthetic peptide
  XENP019754 vhCDR2
FISYDGNNKYYADSVKG

SEQ ID NO: 278 - protein, 9 aa, Artificial Sequence
  Description of Artificial Sequence: Synthetic peptide
  XENP019754 vhCDR3
TGWLGPFDY

SEQ ID NO: 279 - protein, 12 aa, Artificial Sequence
  Description of Artificial Sequence: Synthetic peptide
  XENP019754 vlCDR1
RASQSVGSSYLA

SEQ ID NO: 280 - protein, 7 aa, Artificial Sequence
  Description of Artificial Sequence: Synthetic peptide
  XENP019754 vlCDR2
GAFSRAT

SEQ ID NO: 281 - protein, 9 aa, Artificial Sequence
  Description of Artificial Sequence: Synthetic peptide
  XENP019754 vlCDR3
QQYGSSPWT

SEQ ID NO: 282 - protein, 246 aa, Artificial Sequence
  Description of Artificial Sequence: Synthetic polypeptide
  XENP019755 [CTLA-4]_H0.11_L0_scFv(GKPGS)4
QVQLVESGGGVVQPGRSLRLSCAASGFTVSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 283 - protein, 118 aa, Artificial Sequence
  Description of Artificial Sequence: Synthetic polypeptide
  VH of XENP019755
QVQLVESGGGVVQPGRSLRLSCAASGFTVSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 284 - protein, 108 aa, Artificial Sequence; identical to SEQ ID NO: 23
  Description of Artificial Sequence: Synthetic polypeptide
  VL of XENP019755

SEQ ID NO: 285 - protein, 5 aa, Artificial Sequence
  Description of Artificial Sequence: Synthetic peptide
  XENP019755 vhCDR1
SYTMH

SEQ ID NO: 286 - protein, 17 aa, Artificial Sequence
  Description of Artificial Sequence: Synthetic peptide
  XENP019755 vhCDR2
FISYDGNNKYYADSVKG

SEQ ID NO: 287 - protein, 9 aa, Artificial Sequence
  Description of Artificial Sequence: Synthetic peptide
  XENP019755 vhCDR3
TGWLGPFDY

SEQ ID NO: 288 - protein, 12 aa, Artificial Sequence
  Description of Artificial Sequence: Synthetic peptide
  XENP019755 vlCDR1
RASQSVGSSYLA

SEQ ID NO: 289 - protein, 7 aa, Artificial Sequence
  Description of Artificial Sequence: Synthetic peptide
  XENP019755 vlCDR2
GAFSRAT

SEQ ID NO: 290 - protein, 9 aa, Artificial Sequence
  Description of Artificial Sequence: Synthetic peptide
  XENP019755 vlCDR3
QQYGSSPWT

SEQ ID NO: 291 - protein, 246 aa, Artificial Sequence
  Description of Artificial Sequence: Synthetic polypeptide
  XENP019756 [CTLA-4]_H0.12_L0_scFv(GKPGS)4
QVQLVESGGGVVQPGRSLRLSCAASGFTFSAYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 292 - protein, 118 aa, Artificial Sequence
  Description of Artificial Sequence: Synthetic polypeptide
  VH of XENP019756
QVQLVESGGGVVQPGRSLRLSCAASGFTFSAYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 293 - protein, 108 aa, Artificial Sequence; identical to SEQ ID NO: 23
  Description of Artificial Sequence: Synthetic polypeptide
  VL of XENP019756

SEQ ID NO: 294 - protein, 5 aa, Artificial Sequence
  Description of Artificial Sequence: Synthetic peptide
  XENP019756 vhCDR1
AYTMH

SEQ ID NO: 295 - protein, 17 aa, Artificial Sequence
  Description of Artificial Sequence: Synthetic peptide
  XENP019756 vhCDR2
FISYDGNNKYYADSVKG

SEQ ID NO: 296 - protein, 9 aa, Artificial Sequence
  Description of Artificial Sequence: Synthetic peptide
  XENP019756 vhCDR3
TGWLGPFDY

SEQ ID NO: 297 - protein, 12 aa, Artificial Sequence
  Description of Artificial Sequence: Synthetic peptide
  XENP019756 vlCDR1
RASQSVGSSYLA

SEQ ID NO: 298 - protein, 7 aa, Artificial Sequence
  Description of Artificial Sequence: Synthetic peptide
  XENP019756 vlCDR2
GAFSRAT

SEQ ID NO: 299 - protein, 9 aa, Artificial Sequence
  Description of Artificial Sequence: Synthetic peptide
  XENP019756 vlCDR3
QQYGSSPWT

SEQ ID NO: 300 - protein, 246 aa, Artificial Sequence
  Description of Artificial Sequence: Synthetic polypeptide
  XENP019757 [CTLA-4]_H0.13_L0_scFv(GKPGS)4
QVQLVESGGGVVQPGRSLRLSCAASGFTFSDYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 301 - protein, 118 aa, Artificial Sequence
  Description of Artificial Sequence: Synthetic polypeptide
  VH of XENP019757
QVQLVESGGGVVQPGRSLRLSCAASGFTFSDYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 302 - protein, 108 aa, Artificial Sequence; identical to SEQ ID NO: 23
  Description of Artificial Sequence: Synthetic polypeptide
  VL of XENP019757

SEQ ID NO: 303 - protein, 5 aa, Artificial Sequence
  Description of Artificial Sequence: Synthetic peptide
  XENP019757 vhCDR1
DYTMH

SEQ ID NO: 304 - protein, 17 aa, Artificial Sequence
  Description of Artificial Sequence: Synthetic peptide
  XENP019757 vhCDR2
FISYDGNNKYYADSVKG

SEQ ID NO: 305 - protein, 9 aa, Artificial Sequence
  Description of Artificial Sequence: Synthetic peptide
  XENP019757 vhCDR3
TGWLGPFDY

SEQ ID NO: 306 - protein, 12 aa, Artificial Sequence
  Description of Artificial Sequence: Synthetic peptide
  XENP019757 vlCDR1
RASQSVGSSYLA

SEQ ID NO: 307 - protein, 7 aa, Artificial Sequence
  Description of Artificial Sequence: Synthetic peptide
  XENP019757 vlCDR2
GAFSRAT

SEQ ID NO: 308 - protein, 9 aa, Artificial Sequence
  Description of Artificial Sequence: Synthetic peptide
  XENP019757 vlCDR3
QQYGSSPWT

SEQ ID NO: 309 - protein, 246 aa, Artificial Sequence
  Description of Artificial Sequence: Synthetic polypeptide
  XENP019758 [CTLA-4]_H0.14_L0_scFv(GKPGS)4
QVQLVESGGGVVQPGRSLRLSCAASGFTFSGYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 310 - protein, 118 aa, Artificial Sequence
  Description of Artificial Sequence: Synthetic polypeptide
  VH of XENP019758
QVQLVESGGGVVQPGRSLRLSCAASGFTFSGYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 311 - protein, 108 aa, Artificial Sequence; identical to SEQ ID NO: 23
  Description of Artificial Sequence: Synthetic polypeptide
  VL of XENP019758

SEQ ID NO: 312 - protein, 5 aa, Artificial Sequence
  Description of Artificial Sequence: Synthetic peptide
  XENP019758 vhCDR1
GYTMH

SEQ ID NO: 313 - protein, 17 aa, Artificial Sequence
  Description of Artificial Sequence: Synthetic peptide
  XENP019758 vhCDR2
FISYDGNNKYYADSVKG

SEQ ID NO: 314 - protein, 9 aa, Artificial Sequence
  Description of Artificial Sequence: Synthetic peptide
  XENP019758 vhCDR3
TGWLGPFDY

SEQ ID NO: 315 - protein, 12 aa, Artificial Sequence
  Description of Artificial Sequence: Synthetic peptide
  XENP019758 vlCDR1
RASQSVGSSYLA

SEQ ID NO: 316 - protein, 7 aa, Artificial Sequence
  Description of Artificial Sequence: Synthetic peptide
  XENP019758 vlCDR2
GAFSRAT

SEQ ID NO: 317 - protein, 9 aa, Artificial Sequence
  Description of Artificial Sequence: Synthetic peptide
  XENP019758 vlCDR3
QQYGSSPWT

SEQ ID NO: 318 - protein, 246 aa, Artificial Sequence
  Description of Artificial Sequence: Synthetic polypeptide
  XENP019759 [CTLA-4]_H0.15_L0_scFv(GKPGS)4
QVQLVESGGGVVQPGRSLRLSCAASGFTFSNYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 319 - protein, 118 aa, Artificial Sequence
  Description of Artificial Sequence: Synthetic polypeptide
  VH of XENP019759
QVQLVESGGGVVQPGRSLRLSCAASGFTFSNYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 320 - protein, 108 aa, Artificial Sequence; identical to SEQ ID NO: 23
  Description of Artificial Sequence: Synthetic polypeptide
  VL of XENP019759

SEQ ID NO: 321 - protein, 5 aa, Artificial Sequence
  Description of Artificial Sequence: Synthetic peptide
  XENP019759 vhCDR1
NYTMH

SEQ ID NO: 322 - protein, 17 aa, Artificial Sequence
  Description of Artificial Sequence: Synthetic peptide
  XENP019759 vhCDR2
FISYDGNNKYYADSVKG

SEQ ID NO: 323 - protein, 9 aa, Artificial Sequence
  Description of Artificial Sequence: Synthetic peptide
  XENP019759 vhCDR3
TGWLGPFDY

SEQ ID NO: 324 - protein, 12 aa, Artificial Sequence
  Description of Artificial Sequence: Synthetic peptide
  XENP019759 vlCDR1
RASQSVGSSYLA

SEQ ID NO: 325 - protein, 7 aa, Artificial Sequence
  Description of Artificial Sequence: Synthetic peptide
  XENP019759 vlCDR2
GAFSRAT

SEQ ID NO: 326 - protein, 9 aa, Artificial Sequence
  Description of Artificial Sequence: Synthetic peptide
  XENP019759 vlCDR3
QQYGSSPWT

SEQ ID NO: 327 - protein, 246 aa, Artificial Sequence
  Description of Artificial Sequence: Synthetic polypeptide
  XENP019760 [CTLA-4]_H0.16_L0_scFv(GKPGS)4
QVQLVESGGGVVQPGRSLRLSCAASGFTFSQYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 328 - protein, 118 aa, Artificial Sequence
  Description of Artificial Sequence: Synthetic polypeptide
  VH of XENP019760
QVQLVESGGGVVQPGRSLRLSCAASGFTFSQYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 329 - protein, 108 aa, Artificial Sequence; identical to SEQ ID NO: 23
  Description of Artificial Sequence: Synthetic polypeptide
  VL of XENP019760

SEQ ID NO: 330 - protein, 5 aa, Artificial Sequence
  Description of Artificial Sequence: Synthetic peptide
  XENP019760 vhCDR1
QYTMH

SEQ ID NO: 331 - protein, 17 aa, Artificial Sequence
  Description of Artificial Sequence: Synthetic peptide
  XENP019760 vhCDR2
FISYDGNNKYYADSVKG

SEQ ID NO: 332 - protein, 9 aa, Artificial Sequence
  Description of Artificial Sequence: Synthetic peptide
  XENP019760 vhCDR3
TGWLGPFDY

SEQ ID NO: 333 - protein, 12 aa, Artificial Sequence
  Description of Artificial Sequence: Synthetic peptide
  XENP019760 vlCDR1
RASQSVGSSYLA

SEQ ID NO: 334 - protein, 7 aa, Artificial Sequence
  Description of Artificial Sequence: Synthetic peptide
  XENP019760 vlCDR2
GAFSRAT

SEQ ID NO: 335 - protein, 9 aa, Artificial Sequence
  Description of Artificial Sequence: Synthetic peptide
  XENP019760 vlCDR3
QQYGSSPWT

SEQ ID NO: 336 - protein, 246 aa, Artificial Sequence
  Description of Artificial Sequence: Synthetic polypeptide
  XENP019761 [CTLA-4]_H0.17_L0_scFv(GKPGS)4
QVQLVESGGGVVQPGRSLRLSCAASGFTFSTYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 337 - protein, 118 aa, Artificial Sequence
  Description of Artificial Sequence: Synthetic polypeptide
  VH of XENP019761
QVQLVESGGGVVQPGRSLRLSCAASGFTFSTYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 338 - protein, 108 aa, Artificial Sequence; identical to SEQ ID NO: 23
  Description of Artificial Sequence: Synthetic polypeptide
  VL of XENP019761

SEQ ID NO: 339 - protein, 5 aa, Artificial Sequence
  Description of Artificial Sequence: Synthetic peptide
  XENP019761 vhCDR1
TYTMH

SEQ ID NO: 340 - protein, 17 aa, Artificial Sequence
  Description of Artificial Sequence: Synthetic peptide
  XENP019761 vhCDR2
FISYDGNNKYYADSVKG

SEQ ID NO: 341 - protein, 9 aa, Artificial Sequence
  Description of Artificial Sequence: Synthetic peptide
  XENP019761 vhCDR3
TGWLGPFDY

SEQ ID NO: 342 - protein, 12 aa, Artificial Sequence
  Description of Artificial Sequence: Synthetic peptide
  XENP019761 vlCDR1
RASQSVGSSYLA

SEQ ID NO: 343 - protein, 7 aa, Artificial Sequence
  Description of Artificial Sequence: Synthetic peptide
  XENP019761 vlCDR2
GAFSRAT

SEQ ID NO: 344 - protein, 9 aa, Artificial Sequence
  Description of Artificial Sequence: Synthetic peptide
  XENP019761 vlCDR3
QQYGSSPWT

SEQ ID NO: 345 - protein, 246 aa, Artificial Sequence
  Description of Artificial Sequence: Synthetic polypeptide
  XENP019762 [CTLA-4]_H0.18_L0_scFv(GKPGS)4
QVQLVESGGGVVQPGRSLRLSCAASGFTFSSATMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 346 - protein, 118 aa, Artificial Sequence
  Description of Artificial Sequence: Synthetic polypeptide
  VH of XENP019762
QVQLVESGGGVVQPGRSLRLSCAASGFTFSSATMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 347 - protein, 108 aa, Artificial Sequence; identical to SEQ ID NO: 23
  Description of Artificial Sequence: Synthetic polypeptide
  VL of XENP019762

SEQ ID NO: 348 - protein, 5 aa, Artificial Sequence
  Description of Artificial Sequence: Synthetic peptide
  XENP019762 vhCDR1
SATMH

SEQ ID NO: 349 - protein, 17 aa, Artificial Sequence
  Description of Artificial Sequence: Synthetic peptide
  XENP019762 vhCDR2
FISYDGNNKYYADSVKG

SEQ ID NO: 350 - protein, 9 aa, Artificial Sequence
  Description of Artificial Sequence: Synthetic peptide
  XENP019762 vhCDR3
TGWLGPFDY

SEQ ID NO: 351 - protein, 12 aa, Artificial Sequence
  Description of Artificial Sequence: Synthetic peptide
  XENP019762 vlCDR1
RASQSVGSSYLA

SEQ ID NO: 352 - protein, 7 aa, Artificial Sequence
  Description of Artificial Sequence: Synthetic peptide
  XENP019762 vlCDR2
GAFSRAT

SEQ ID NO: 353 - protein, 9 aa, Artificial Sequence
  Description of Artificial Sequence: Synthetic peptide
  XENP019762 vlCDR3
QQYGSSPWT

SEQ ID NO: 354 - protein, 246 aa, Artificial Sequence
  Description of Artificial Sequence: Synthetic polypeptide
  XENP019763 [CTLA-4]_H0.19_L0_scFv(GKPGS)4
QVQLVESGGGVVQPGRSLRLSCAASGFTFSSHTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 355 - protein, 118 aa, Artificial Sequence
  Description of Artificial Sequence: Synthetic polypeptide
  VH of XENP019763
QVQLVESGGGVVQPGRSLRLSCAASGFTFSSHTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 356 - protein, 108 aa, Artificial Sequence; identical to SEQ ID NO: 23
  Description of Artificial Sequence: Synthetic polypeptide
  VL of XENP019763

SEQ ID NO: 357 - protein, 5 aa, Artificial Sequence
  Description of Artificial Sequence: Synthetic peptide
  XENP019763 vhCDR1
SHTMH

SEQ ID NO: 358 - protein, 17 aa, Artificial Sequence
  Description of Artificial Sequence: Synthetic peptide
  XENP019763 vhCDR2
FISYDGNNKYYADSVKG

SEQ ID NO: 359 - protein, 9 aa, Artificial Sequence
  Description of Artificial Sequence: Synthetic peptide
  XENP019763 vhCDR3
TGWLGPFDY

SEQ ID NO: 360 - protein, 12 aa, Artificial Sequence
  Description of Artificial Sequence: Synthetic peptide
  XENP019763 vlCDR1
RASQSVGSSYLA

SEQ ID NO: 361 - protein, 7 aa, Artificial Sequence
  Description of Artificial Sequence: Synthetic peptide
  XENP019763 vlCDR2
GAFSRAT

SEQ ID NO: 362 - protein, 9 aa, Artificial Sequence
  Description of Artificial Sequence: Synthetic peptide
  XENP019763 vlCDR3
QQYGSSPWT

SEQ ID NO: 363 - protein, 246 aa, Artificial Sequence
  Description of Artificial Sequence: Synthetic polypeptide
  XENP019764 [CTLA-4]_H0.20_L0_scFv(GKPGS)4
QVQLVESGGGVVQPGRSLRLSCAASGFTFSSFTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 364 - protein, 118 aa, Artificial Sequence
  Description of Artificial Sequence: Synthetic polypeptide
  VH of XENP019764
QVQLVESGGGVVQPGRSLRLSCAASGFTFSSFTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 365 - protein, 108 aa, Artificial Sequence; identical to SEQ ID NO: 23
  Description of Artificial Sequence: Synthetic polypeptide
  VL of XENP019764

SEQ ID NO: 366 - protein, 5 aa, Artificial Sequence
  Description of Artificial Sequence: Synthetic peptide
  XENP019764 vhCDR1
SFTMH

SEQ ID NO: 367 - protein, 17 aa, Artificial Sequence
  Description of Artificial Sequence: Synthetic peptide
  XENP019764 vhCDR2
FISYDGNNKYYADSVKG

SEQ ID NO: 368 - protein, 9 aa, Artificial Sequence
  Description of Artificial Sequence: Synthetic peptide
  XENP019764 vhCDR3
TGWLGPFDY

SEQ ID NO: 369 - protein, 12 aa, Artificial Sequence
  Description of Artificial Sequence: Synthetic peptide
  XENP019764 vlCDR1
RASQSVGSSYLA

SEQ ID NO: 370 - protein, 7 aa, Artificial Sequence
  Description of Artificial Sequence: Synthetic peptide
  XENP019764 vlCDR2
GAFSRAT

SEQ ID NO: 371 - protein, 9 aa, Artificial Sequence
  Description of Artificial Sequence: Synthetic peptide
  XENP019764 vlCDR3
QQYGSSPWT

SEQ ID NO: 372 - protein, 246 aa, Artificial Sequence
  Description of Artificial Sequence: Synthetic polypeptide
  XENP019765 [CTLA-4]_H0.21_L0_scFv(GKPGS)4
QVQLVESGGGVVQPGRSLRLSCAASGFTFSSLTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 373 - protein, 118 aa, Artificial Sequence
  Description of Artificial Sequence: Synthetic polypeptide
  VH of XENP019765
QVQLVESGGGVVQPGRSLRLSCAASGFTFSSLTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 374 - protein, 108 aa, Artificial Sequence; identical to SEQ ID NO: 23
  Description of Artificial Sequence: Synthetic polypeptide
  VL of XENP019765

SEQ ID NO: 375 - protein, 5 aa, Artificial Sequence
  Description of Artificial Sequence: Synthetic peptide
  XENP019765 vhCDR1
SLTMH

SEQ ID NO: 376 - protein, 17 aa, Artificial Sequence
  Description of Artificial Sequence: Synthetic peptide
  XENP019765 vhCDR2
FISYDGNNKYYADSVKG

SEQ ID NO: 377 - protein, 9 aa, Artificial Sequence
  Description of Artificial Sequence: Synthetic peptide
  XENP019765 vhCDR3
TGWLGPFDY

SEQ ID NO: 378 - protein, 12 aa, Artificial Sequence
  Description of Artificial Sequence: Synthetic peptide
  XENP019765 vlCDR1
RASQSVGSSYLA

SEQ ID NO: 379 - protein, 7 aa, Artificial Sequence
  Description of Artificial Sequence: Synthetic peptide
  XENP019765 vlCDR2
GAFSRAT

SEQ ID NO: 380 - protein, 9 aa, Artificial Sequence
  Description of Artificial Sequence: Synthetic peptide
  XENP019765 vlCDR3
QQYGSSPWT

SEQ ID NO: 381 - protein, 246 aa, Artificial Sequence
  Description of Artificial Sequence: Synthetic polypeptide
  XENP019766 [CTLA-4]_H0.22_L0_scFv(GKPGS)4
QVQLVESGGGVVQPGRSLRLSCAASGFTFSSNTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 382 - protein, 118 aa, Artificial Sequence
  Description of Artificial Sequence: Synthetic polypeptide
  VH of XENP019766
QVQLVESGGGVVQPGRSLRLSCAASGFTFSSNTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 383 - protein, 108 aa, Artificial Sequence; identical to SEQ ID NO: 23
  Description of Artificial Sequence: Synthetic polypeptide
  VL of XENP019766

SEQ ID NO: 384 - protein, 5 aa, Artificial Sequence
  Description of Artificial Sequence: Synthetic peptide
  XENP019766 vhCDR1
SNTMH

SEQ ID NO: 385 - protein, 17 aa, Artificial Sequence
  Description of Artificial Sequence: Synthetic peptide
  XENP019766 vhCDR2
FISYDGNNKYYADSVKG

SEQ ID NO: 386 - protein, 9 aa, Artificial Sequence
  Description of Artificial Sequence: Synthetic peptide
  XENP019766 vhCDR3
TGWLGPFDY

SEQ ID NO: 387 - protein, 12 aa, Artificial Sequence
  Description of Artificial Sequence: Synthetic peptide
  XENP019766 vlCDR1
RASQSVGSSYLA

SEQ ID NO: 388 - protein, 7 aa, Artificial Sequence
  Description of Artificial Sequence: Synthetic peptide
  XENP019766 vlCDR2
GAFSRAT

SEQ ID NO: 389 - protein, 9 aa, Artificial Sequence
  Description of Artificial Sequence: Synthetic peptide
  XENP019766 vlCDR3
QQYGSSPWT

SEQ ID NO: 390 - protein, 246 aa, Artificial Sequence
  Description of Artificial Sequence: Synthetic polypeptide
  XENP019767 [CTLA-4]_H0.23_L0_scFv(GKPGS)4
QVQLVESGGGVVQPGRSLRLSCAASGFTFSSSTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 391 - protein, 118 aa, Artificial Sequence
  Description of Artificial Sequence: Synthetic polypeptide
  VH of XENP019767
QVQLVESGGGVVQPGRSLRLSCAASGFTFSSSTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 392 - protein, 108 aa, Artificial Sequence; identical to SEQ ID NO: 23
  Description of Artificial Sequence: Synthetic polypeptide
  VL of XENP019767

SEQ ID NO: 393 - protein, 5 aa, Artificial Sequence
  Description of Artificial Sequence: Synthetic peptide
  XENP019767 vhCDR1
SSTMH

SEQ ID NO: 394 - protein, 17 aa, Artificial Sequence
  Description of Artificial Sequence: Synthetic peptide
  XENP019767 vhCDR2
FISYDGNNKYYADSVKG

SEQ ID NO: 395 - protein, 9 aa, Artificial Sequence
  Description of Artificial Sequence: Synthetic peptide
  XENP019767 vhCDR3
TGWLGPFDY

SEQ ID NO: 396 - protein, 12 aa, Artificial Sequence
  Description of Artificial Sequence: Synthetic peptide
  XENP019767 vlCDR1
RASQSVGSSYLA

SEQ ID NO: 397 - protein, 7 aa, Artificial Sequence
  Description of Artificial Sequence: Synthetic peptide
  XENP019767 vlCDR2
GAFSRAT

SEQ ID NO: 398 - protein, 9 aa, Artificial Sequence
  Description of Artificial Sequence: Synthetic peptide
  XENP019767 vlCDR3
QQYGSSPWT

SEQ ID NO: 399 - protein, 246 aa, Artificial Sequence
  Description of Artificial Sequence: Synthetic polypeptide
  XENP019768 [CTLA-4]_H0.24_L0_scFv(GKPGS)4
QVQLVESGGGVVQPGRSLRLSCAASGFTFSSVTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 400 - protein, 118 aa, Artificial Sequence
  Description of Artificial Sequence: Synthetic polypeptide
  VH of XENP019768
QVQLVESGGGVVQPGRSLRLSCAASGFTFSSVTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 401 - protein, 108 aa, Artificial Sequence; identical to SEQ ID NO: 23
  Description of Artificial Sequence: Synthetic polypeptide
  VL of XENP019768

SEQ ID NO: 402 - protein, 5 aa, Artificial Sequence
  Description of Artificial Sequence: Synthetic peptide
  XENP019768 vhCDR1
SVTMH

SEQ ID NO: 403 - protein, 17 aa, Artificial Sequence
  Description of Artificial Sequence: Synthetic peptide
  XENP019768 vhCDR2
FISYDGNNKYYADSVKG

SEQ ID NO: 404 - protein, 9 aa, Artificial Sequence
  Description of Artificial Sequence: Synthetic peptide
  XENP019768 vhCDR3
TGWLGPFDY

SEQ ID NO: 405 - protein, 12 aa, Artificial Sequence
  Description of Artificial Sequence: Synthetic peptide
  XENP019768 vlCDR1
RASQSVGSSYLA

SEQ ID NO: 406 - protein, 7 aa, Artificial Sequence
  Description of Artificial Sequence: Synthetic peptide
  XENP019768 vlCDR2
GAFSRAT

SEQ ID NO: 407 - protein, 9 aa, Artificial Sequence
  Description of Artificial Sequence: Synthetic peptide
  XENP019768 vlCDR3
QQYGSSPWT

SEQ ID NO: 408 - protein, 246 aa, Artificial Sequence
  Description of Artificial Sequence: Synthetic polypeptide
  XENP019769 [CTLA-4]_H0.25_L0_scFv(GKPGS)4
QVQLVESGGGVVQPGRSLRLSCAASGFTFSSYAMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 409 - protein, 118 aa, Artificial Sequence
  Description of Artificial Sequence: Synthetic polypeptide
  VH of XENP019769
QVQLVESGGGVVQPGRSLRLSCAASGFTFSSYAMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 410 - protein, 108 aa, Artificial Sequence; identical to SEQ ID NO: 23
  Description of Artificial Sequence: Synthetic polypeptide
  VL of XENP019769

SEQ ID NO: 411 - protein, 5 aa, Artificial Sequence
  Description of Artificial Sequence: Synthetic peptide
  XENP019769 vhCDR1
SYAMH

SEQ ID NO: 412 - protein, 17 aa, Artificial Sequence
  Description of Artificial Sequence: Synthetic peptide
  XENP019769 vhCDR2
FISYDGNNKYYADSVKG

SEQ ID NO: 413 - protein, 9 aa, Artificial Sequence
  Description of Artificial Sequence: Synthetic peptide
  XENP019769 vhCDR3
TGWLGPFDY

SEQ ID NO: 414 - protein, 12 aa, Artificial Sequence
  Description of Artificial Sequence: Synthetic peptide
  XENP019769 vlCDR1
RASQSVGSSYLA

SEQ ID NO: 415 - protein, 7 aa, Artificial Sequence
  Description of Artificial Sequence: Synthetic peptide
  XENP019769 vlCDR2
GAFSRAT

SEQ ID NO: 416 - protein, 9 aa, Artificial Sequence
  Description of Artificial Sequence: Synthetic peptide
  XENP019769 vlCDR3
QQYGSSPWT

SEQ ID NO: 417 - protein, 246 aa, Artificial Sequence
  Description of Artificial Sequence: Synthetic polypeptide
  XENP019770 [CTLA-4]_H0.26_L0_scFv(GKPGS)4
QVQLVESGGGVVQPGRSLRLSCAASGFTFSSYGMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 418 - protein, 118 aa, Artificial Sequence
  Description of Artificial Sequence: Synthetic polypeptide
  VH of XENP019770
QVQLVESGGGVVQPGRSLRLSCAASGFTFSSYGMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 419 - protein, 108 aa, Artificial Sequence; identical to SEQ ID NO: 23
  Description of Artificial Sequence: Synthetic polypeptide
  VL of XENP019770

SEQ ID NO: 420 - protein, 5 aa, Artificial Sequence
  Description of Artificial Sequence: Synthetic peptide
  XENP019770 vhCDR1
SYGMH

SEQ ID NO: 421 - protein, 17 aa, Artificial Sequence
  Description of Artificial Sequence: Synthetic peptide
  XENP019770 vhCDR2
FISYDGNNKYYADSVKG

SEQ ID NO: 422 - protein, 9 aa, Artificial Sequence
  Description of Artificial Sequence: Synthetic peptide
  XENP019770 vhCDR3
TGWLGPFDY

SEQ ID NO: 423 - protein, 12 aa, Artificial Sequence
  Description of Artificial Sequence: Synthetic peptide
  XENP019770 vlCDR1
RASQSVGSSYLA

SEQ ID NO: 424 - protein, 7 aa, Artificial Sequence
  Description of Artificial Sequence: Synthetic peptide
  XENP019770 vlCDR2
GAFSRAT

SEQ ID NO: 425 - protein, 9 aa, Artificial Sequence
  Description of Artificial Sequence: Synthetic peptide
  XENP019770 vlCDR3
QQYGSSPWT

SEQ ID NO: 426 - protein, 246 aa, Artificial Sequence
  Description of Artificial Sequence: Synthetic polypeptide
  XENP019771 [CTLA-4]_H0.27_L0_scFv(GKPGS)4
QVQLVESGGGVVQPGRSLRLSCAASGFTFSSYSMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 427 - protein, 118 aa, Artificial Sequence
  Description of Artificial Sequence: Synthetic polypeptide
  VH of XENP019771
QVQLVESGGGVVQPGRSLRLSCAASGFTFSSYSMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 428 - protein, 108 aa, Artificial Sequence; identical to SEQ ID NO: 23
  Description of Artificial Sequence: Synthetic polypeptide
  VL of XENP019771

SEQ ID NO: 429 - protein, 5 aa, Artificial Sequence
  Description of Artificial Sequence: Synthetic peptide
  XENP019771 vhCDR1
SYSMH

SEQ ID NO: 430 - protein, 17 aa, Artificial Sequence
  Description of Artificial Sequence: Synthetic peptide
  XENP019771 vhCDR2
FISYDGNNKYYADSVKG

SEQ ID NO: 431 - protein, 9 aa, Artificial Sequence
  Description of Artificial Sequence: Synthetic peptide
  XENP019771 vhCDR3
TGWLGPFDY

SEQ ID NO: 432 - protein, 12 aa, Artificial Sequence
  Description of Artificial Sequence: Synthetic peptide
  XENP019771 vlCDR1
RASQSVGSSYLA

SEQ ID NO: 433 - protein, 7 aa, Artificial Sequence
  Description of Artificial Sequence: Synthetic peptide
  XENP019771 vlCDR2
GAFSRAT

SEQ ID NO: 434 - protein, 9 aa, Artificial Sequence
  Description of Artificial Sequence: Synthetic peptide
  XENP019771 vlCDR3
QQYGSSPWT

SEQ ID NO: 435 - protein, 246 aa, Artificial Sequence
  Description of Artificial Sequence: Synthetic polypeptide
  XENP019772 [CTLA-4]_H0.28_L0_scFv(GKPGS)4
QVQLVESGGGVVQPGRSLRLSCAASGFTFSSYVMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 436 - protein, 118 aa, Artificial Sequence
  Description of Artificial Sequence: Synthetic polypeptide
  VH of XENP019772
QVQLVESGGGVVQPGRSLRLSCAASGFTFSSYVMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 437 - protein, 108 aa, Artificial Sequence; identical to SEQ ID NO: 23
  Description of Artificial Sequence: Synthetic polypeptide
  VL of XENP019772

SEQ ID NO: 438 - protein, 5 aa, Artificial Sequence
  Description of Artificial Sequence: Synthetic peptide
  XENP019772 vhCDR1
SYVMH

SEQ ID NO: 439 - protein, 17 aa, Artificial Sequence
  Description of Artificial Sequence: Synthetic peptide
  XENP019772 vhCDR2
FISYDGNNKYYADSVKG

SEQ ID NO: 440 - protein, 9 aa, Artificial Sequence
  Description of Artificial Sequence: Synthetic peptide
  XENP019772 vhCDR3
TGWLGPFDY

SEQ ID NO: 441 - protein, 12 aa, Artificial Sequence
  Description of Artificial Sequence: Synthetic peptide
  XENP019772 vlCDR1
RASQSVGSSYLA

SEQ ID NO: 442 - protein, 7 aa, Artificial Sequence
  Description of Artificial Sequence: Synthetic peptide
  XENP019772 vlCDR2
GAFSRAT

SEQ ID NO: 443 - protein, 9 aa, Artificial Sequence
  Description of Artificial Sequence: Synthetic peptide
  XENP019772 vlCDR3
QQYGSSPWT

SEQ ID NO: 444 - protein, 246 aa, Artificial Sequence
  Description of Artificial Sequence: Synthetic polypeptide
  XENP019773 [CTLA-4]_H0.29_L0_scFv(GKPGS)4
QVQLVESGGGVVQPGRSLRLSCAASGFTFSSYYMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 445 - protein, 118 aa, Artificial Sequence
  Description of Artificial Sequence: Synthetic polypeptide
  VH of XENP019773
QVQLVESGGGVVQPGRSLRLSCAASGFTFSSYYMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 446 - protein, 108 aa, Artificial Sequence; identical to SEQ ID NO: 23
  Description of Artificial Sequence: Synthetic polypeptide
  VL of XENP019773

SEQ ID NO: 447 - protein, 5 aa, Artificial Sequence
  Description of Artificial Sequence: Synthetic peptide
  XENP019773 vhCDR1
SYYMH

SEQ ID NO: 448 - protein, 17 aa, Artificial Sequence
  Description of Artificial Sequence: Synthetic peptide
  XENP019773 vhCDR2
FISYDGNNKYYADSVKG

SEQ ID NO: 449 - protein, 9 aa, Artificial Sequence
  Description of Artificial Sequence: Synthetic peptide
  XENP019773 vhCDR3
TGWLGPFDY

SEQ ID NO: 450 - protein, 12 aa, Artificial Sequence
  Description of Artificial Sequence: Synthetic peptide
  XENP019773 vlCDR1
RASQSVGSSYLA

SEQ ID NO: 451 - protein, 7 aa, Artificial Sequence
  Description of Artificial Sequence: Synthetic peptide
  XENP019773 vlCDR2
GAFSRAT

SEQ ID NO: 452 - protein, 9 aa, Artificial Sequence
  Description of Artificial Sequence: Synthetic peptide
  XENP019773 vlCDR3
QQYGSSPWT

SEQ ID NO: 453 - protein, 246 aa, Artificial Sequence
  Description of Artificial Sequence: Synthetic polypeptide
  XENP019774 [CTLA-4]_H0.30_L0_scFv(GKPGS)4
QVQLVESGGGVVQPGRSLRLSCAASGFTFSSYTMDWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 454 - protein, 118 aa, Artificial Sequence
  Description of Artificial Sequence: Synthetic polypeptide
  VH of XENP019774
QVQLVESGGGVVQPGRSLRLSCAASGFTFSSYTMDWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 455 - protein, 108 aa, Artificial Sequence; identical to SEQ ID NO: 23
  Description of Artificial Sequence: Synthetic polypeptide
  VL of XENP019774

SEQ ID NO: 456 - protein, 5 aa, Artificial Sequence
  Description of Artificial Sequence: Synthetic peptide
  XENP019774 vhCDR1
SYTMD

SEQ ID NO: 457 - protein, 17 aa, Artificial Sequence
  Description of Artificial Sequence: Synthetic peptide
  XENP019774 vhCDR2
FISYDGNNKYYADSVKG

SEQ ID NO: 458 - protein, 9 aa, Artificial Sequence
  Description of Artificial Sequence: Synthetic peptide
  XENP019774 vhCDR3
TGWLGPFDY

SEQ ID NO: 459 - protein, 12 aa, Artificial Sequence
  Description of Artificial Sequence: Synthetic peptide
  XENP019774 vlCDR1
RASQSVGSSYLA

SEQ ID NO: 460 - protein, 7 aa, Artificial Sequence
  Description of Artificial Sequence: Synthetic peptide
  XENP019774 vlCDR2
GAFSRAT

SEQ ID NO: 461 - protein, 9 aa, Artificial Sequence
  Description of Artificial Sequence: Synthetic peptide
  XENP019774 vlCDR3
QQYGSSPWT

SEQ ID NO: 462 - protein, 246 aa, Artificial Sequence
  Description of Artificial Sequence: Synthetic polypeptide
  XENP019775 [CTLA-4]_H0.31_L0_scFv(GKPGS)4
QVQLVESGGGVVQPGRSLRLSCAASGFTFSSYTMFWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 463 - protein, 118 aa, Artificial Sequence
  Description of Artificial Sequence: Synthetic polypeptide
  VH of XENP019775
QVQLVESGGGVVQPGRSLRLSCAASGFTFSSYTMFWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 464 - protein, 108 aa, Artificial Sequence; identical to SEQ ID NO: 23
  Description of Artificial Sequence: Synthetic polypeptide
  VL of XENP019775

SEQ ID NO: 465 - protein, 5 aa, Artificial Sequence
  Description of Artificial Sequence: Synthetic peptide
  XENP019775 vhCDR1
SYTMF

SEQ ID NO: 466 - protein, 17 aa, Artificial Sequence
  Description of Artificial Sequence: Synthetic peptide
  XENP019775 vhCDR2
FISYDGNNKYYADSVKG

SEQ ID NO: 467 - protein, 9 aa, Artificial Sequence
  Description of Artificial Sequence: Synthetic peptide
  XENP019775 vhCDR3
TGWLGPFDY

SEQ ID NO: 468 - protein, 12 aa, Artificial Sequence
  Description of Artificial Sequence: Synthetic peptide
  XENP019775 vlCDR1
RASQSVGSSYLA

SEQ ID NO: 469 - protein, 7 aa, Artificial Sequence
  Description of Artificial Sequence: Synthetic peptide
  XENP019775 vlCDR2
GAFSRAT

SEQ ID NO: 470 - protein, 9 aa, Artificial Sequence
  Description of Artificial Sequence: Synthetic peptide
  XENP019775 vlCDR3
QQYGSSPWT

SEQ ID NO: 471 - protein, 246 aa, Artificial Sequence
  Description of Artificial Sequence: Synthetic polypeptide
  XENP019776 [CTLA-4]_H0.32_L0_scFv(GKPGS)4
QVQLVESGGGVVQPGRSLRLSCAASGFTFSSYTMNWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 472 - protein, 118 aa, Artificial Sequence
  Description of Artificial Sequence: Synthetic polypeptide
  VH of XENP019776
QVQLVESGGGVVQPGRSLRLSCAASGFTFSSYTMNWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 473 - protein, 108 aa, Artificial Sequence; identical to SEQ ID NO: 23
  Description of Artificial Sequence: Synthetic polypeptide
  VL of XENP019776

SEQ ID NO: 474 - protein, 5 aa, Artificial Sequence
  Description of Artificial Sequence: Synthetic peptide
  XENP019776 vhCDR1
SYTMN

SEQ ID NO: 475 - protein, 17 aa, Artificial Sequence
  Description of Artificial Sequence: Synthetic peptide
  XENP019776 vhCDR2
FISYDGNNKYYADSVKG

SEQ ID NO: 476 - protein, 9 aa, Artificial Sequence
  Description of Artificial Sequence: Synthetic peptide
  XENP019776 vhCDR3
TGWLGPFDY

SEQ ID NO: 477 - protein, 12 aa, Artificial Sequence
  Description of Artificial Sequence: Synthetic peptide
  XENP019776 vlCDR1
RASQSVGSSYLA

SEQ ID NO: 478 - protein, 7 aa, Artificial Sequence
  Description of Artificial Sequence: Synthetic peptide
  XENP019776 vlCDR2
GAFSRAT

SEQ ID NO: 479 - protein, 9 aa, Artificial Sequence
  Description of Artificial Sequence: Synthetic peptide
  XENP019776 vlCDR3
QQYGSSPWT

SEQ ID NO: 480 - protein, 246 aa, Artificial Sequence
  Description of Artificial Sequence: Synthetic polypeptide
  XENP019777 [CTLA-4]_H0.33_L0_scFv(GKPGS)4
QVQLVESGGGVVQPGRSLRLSCAASGFTFSSYTMSWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 481 - protein, 118 aa, Artificial Sequence
  Description of Artificial Sequence: Synthetic polypeptide
  VH of XENP019777
QVQLVESGGGVVQPGRSLRLSCAASGFTFSSYTMSWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 482 - protein, 108 aa, Artificial Sequence; identical to SEQ ID NO: 23
  Description of Artificial Sequence: Synthetic polypeptide
  VL of XENP019777

SEQ ID NO: 483 - protein, 5 aa, Artificial Sequence
  Description of Artificial Sequence: Synthetic peptide
  XENP019777 vhCDR1
SYTMS

SEQ ID NO: 484 - protein, 17 aa, Artificial Sequence
  Description of Artificial Sequence: Synthetic peptide
  XENP019777 vhCDR2
FISYDGNNKYYADSVKG

SEQ ID NO: 485 - protein, 9 aa, Artificial Sequence
  Description of Artificial Sequence: Synthetic peptide
  XENP019777 vhCDR3
TGWLGPFDY

SEQ ID NO: 486 - protein, 12 aa, Artificial Sequence
  Description of Artificial Sequence: Synthetic peptide
  XENP019777 vlCDR1
RASQSVGSSYLA

SEQ ID NO: 487 - protein, 7 aa, Artificial Sequence
  Description of Artificial Sequence: Synthetic peptide
  XENP019777 vlCDR2
GAFSRAT

SEQ ID NO: 488 - protein, 9 aa, Artificial Sequence
  Description of Artificial Sequence: Synthetic peptide
  XENP019777 vlCDR3
QQYGSSPWT

SEQ ID NO: 489 - protein, 246 aa, Artificial Sequence
  Description of Artificial Sequence: Synthetic polypeptide
  XENP019778 [CTLA-4]_H0.34_L0_scFv(GKPGS)4
QVQLVESGGGVVQPGRSLRLSCAASGFTFSSYTMYWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 490 - protein, 118 aa, Artificial Sequence
  Description of Artificial Sequence: Synthetic polypeptide
  VH of XENP019778
QVQLVESGGGVVQPGRSLRLSCAASGFTFSSYTMYWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 491 - protein, 108 aa, Artificial Sequence; identical to SEQ ID NO: 23
  Description of Artificial Sequence: Synthetic polypeptide
  VL of XENP019778

SEQ ID NO: 492 - protein, 5 aa, Artificial Sequence
  Description of Artificial Sequence: Synthetic peptide
  XENP019778 vhCDR1
SYTMY

SEQ ID NO: 493 - protein, 17 aa, Artificial Sequence
  Description of Artificial Sequence: Synthetic peptide
  XENP019778 vhCDR2
FISYDGNNKYYADSVKG

SEQ ID NO: 494 - protein, 9 aa, Artificial Sequence
  Description of Artificial Sequence: Synthetic peptide
  XENP019778 vhCDR3
TGWLGPFDY

SEQ ID NO: 495 - protein, 12 aa, Artificial Sequence
  Description of Artificial Sequence: Synthetic peptide
  XENP019778 vlCDR1
RASQSVGSSYLA

SEQ ID NO: 496 - protein, 7 aa, Artificial Sequence
  Description of Artificial Sequence: Synthetic peptide
  XENP019778 vlCDR2
GAFSRAT

SEQ ID NO: 497 - protein, 9 aa, Artificial Sequence
  Description of Artificial Sequence: Synthetic peptide
  XENP019778 vlCDR3
QQYGSSPWT

SEQ ID NO: 498 - protein, 246 aa, Artificial Sequence
  Description of Artificial Sequence: Synthetic polypeptide
  XENP019779 [CTLA-4]_H0.35_L0_scFv(GKPGS)4
QVQLVESGGGVVQPGRSLRLSCAASGFTFSSYTMHWIRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 499 - protein, 118 aa, Artificial Sequence
  Description of Artificial Sequence: Synthetic polypeptide
  VH of XENP019779
QVQLVESGGGVVQPGRSLRLSCAASGFTFSSYTMHWIRQAPGKGLEWVTFISYDGNNKYYADSVKGRFTISRDNSKNTLYLQMNSLRAEDTAIYYCARTGWLGPFDYWGQGTLVTVSS

SEQ ID NO: 500 - protein, 108 aa, Artificial Sequence; identical to SEQ ID NO: 23
  Description of Artificial Sequence: Synthetic polypeptide
  VL of XENP019779

SEQ ID NO: 501 - protein, 5 aa, Artificial Sequence
  Description of Artificial Sequence: Synthetic peptide
  XENP019779 vhCDR1
SYTMH

SEQ ID NO: 502 - protein, 17 aa, Artificial Sequence
  Description of Artificial Sequence: Synthetic peptide
  XENP019779 vhCDR2
FISYDGNNKYYADSVKG

SEQ ID NO: 503 - protein, 9 aa, Artificial Sequence
  Description of Artificial Sequence: Synthetic peptide
  XENP019779 vhCDR3
TGWLGPFDY

SEQ ID NO: 504 - protein, 12 aa, Artificial Sequence
  Description of Artificial Sequence: Synthetic peptide
  XENP019779 vlCDR1
RASQSVGSSYLA

SEQ ID NO: 505 - protein, 7 aa, Artificial Sequence
  Description of Artificial Sequence: Synthetic peptide
  XENP019779 vlCDR2
GAFSRAT

SEQ ID NO: 506 - protein, 9 aa, Artificial Sequence
  Description of Artificial Sequence: Synthetic peptide
  XENP019779 vlCDR3
QQYGSSPWT

SEQ ID NO: 507 - protein, 246 aa, Artificial Sequence
  Description of Artificial Sequence: Synthetic polypeptide
  XENP019780 [CTLA-4]_H0.36_L0_scFv(GKPGS)4
QVQLVESGGGVVQPGRSLRLSCAASGFTFSSYTMHWVRKAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 508 - protein, 118 aa, Artificial Sequence; identical to SEQ ID NO: 31
  Description of Artificial Sequence: Synthetic polypeptide
  VH of XENP019780

SEQ ID NO: 509 - protein, 108 aa, Artificial Sequence; identical to SEQ ID NO: 23
  Description of Artificial Sequence: Synthetic polypeptide
  VL of XENP019780

SEQ ID NO: 510 - protein, 5 aa, Artificial Sequence
  Description of Artificial Sequence: Synthetic peptide
  XENP019780 vhCDR1
SYTMH

SEQ ID NO: 511 - protein, 17 aa, Artificial Sequence
  Description of Artificial Sequence: Synthetic peptide
  XENP019780 vhCDR2
FISYDGNNKYYADSVKG

SEQ ID NO: 512 - protein, 9 aa, Artificial Sequence
  Description of Artificial Sequence: Synthetic peptide
  XENP019780 vhCDR3
TGWLGPFDY

SEQ ID NO: 513 - protein, 12 aa, Artificial Sequence
  Description of Artificial Sequence: Synthetic peptide
  XENP019780 vlCDR1
RASQSVGSSYLA

SEQ ID NO: 514 - protein, 7 aa, Artificial Sequence
  Description of Artificial Sequence: Synthetic peptide
  XENP019780 vlCDR2
GAFSRAT

SEQ ID NO: 515 - protein, 9 aa, Artificial Sequence
  Description of Artificial Sequence: Synthetic peptide
  XENP019780 vlCDR3
QQYGSSPWT

SEQ ID NO: 516 - protein, 246 aa, Artificial Sequence
  Description of Artificial Sequence: Synthetic polypeptide
  XENP019781 [CTLA-4]_H0.37_L0_scFv(GKPGS)4
QVQLVESGGGVVQPGRSLRLSCAASGFTFSSYTMHWVRQAPGKRLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 517 - protein, 118 aa, Artificial Sequence; identical to SEQ ID NO: 49
  Description of Artificial Sequence: Synthetic polypeptide
  VH of XENP019781

SEQ ID NO: 518 - protein, 108 aa, Artificial Sequence; identical to SEQ ID NO: 23
  Description of Artificial Sequence: Synthetic polypeptide
  VL of XENP019781

SEQ ID NO: 519 - protein, 5 aa, Artificial Sequence
  Description of Artificial Sequence: Synthetic peptide
  XENP019781 vhCDR1
SYTMH

SEQ ID NO: 520 - protein, 17 aa, Artificial Sequence
  Description of Artificial Sequence: Synthetic peptide
  XENP019781 vhCDR2
FISYDGNNKYYADSVKG

SEQ ID NO: 521 - protein, 9 aa, Artificial Sequence
  Description of Artificial Sequence: Synthetic peptide
  XENP019781 vhCDR3
TGWLGPFDY

SEQ ID NO: 522 - protein, 12 aa, Artificial Sequence
  Description of Artificial Sequence: Synthetic peptide
  XENP019781 vlCDR1
RASQSVGSSYLA

SEQ ID NO: 523 - protein, 7 aa, Artificial Sequence
  Description of Artificial Sequence: Synthetic peptide
  XENP019781 vlCDR2
GAFSRAT

SEQ ID NO: 524 - protein, 9 aa, Artificial Sequence
  Description of Artificial Sequence: Synthetic peptide
  XENP019781 vlCDR3
QQYGSSPWT

SEQ ID NO: 525 - protein, 246 aa, Artificial Sequence
  Description of Artificial Sequence: Synthetic polypeptide
  XENP019782 [CTLA-4]_H0.38_L0_scFv(GKPGS)4
QVQLVESGGGVVQPGRSLRLSCAASGFTFSSYTMHWVRQAPGKGLEWVAFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 526 - protein, 118 aa, Artificial Sequence
  Description of Artificial Sequence: Synthetic polypeptide
  VH of XENP019782
QVQLVESGGGVVQPGRSLRLSCAASGFTFSSYTMHWVRQAPGKGLEWVAFISYDGNNKYYADSVKGRFTISRDNSKNTLYLQMNSLRAEDTAIYYCARTGWLGPFDYWGQGTLVTVSS

SEQ ID NO: 527 - protein, 108 aa, Artificial Sequence; identical to SEQ ID NO: 23
  Description of Artificial Sequence: Synthetic polypeptide
  VL of XENP019782

SEQ ID NO: 528 - protein, 5 aa, Artificial Sequence
  Description of Artificial Sequence: Synthetic peptide
  XENP019782 vhCDR1
SYTMH

SEQ ID NO: 529 - protein, 17 aa, Artificial Sequence
  Description of Artificial Sequence: Synthetic peptide
  XENP019782 vhCDR2
FISYDGNNKYYADSVKG

SEQ ID NO: 530 - protein, 9 aa, Artificial Sequence
  Description of Artificial Sequence: Synthetic peptide
  XENP019782 vhCDR3
TGWLGPFDY

SEQ ID NO: 531 - protein, 12 aa, Artificial Sequence
  Description of Artificial Sequence: Synthetic peptide
  XENP019782 vlCDR1
RASQSVGSSYLA

SEQ ID NO: 532 - protein, 7 aa, Artificial Sequence
  Description of Artificial Sequence: Synthetic peptide
  XENP019782 vlCDR2
GAFSRAT

SEQ ID NO: 533 - protein, 9 aa, Artificial Sequence
  Description of Artificial Sequence: Synthetic peptide
  XENP019782 vlCDR3
QQYGSSPWT

SEQ ID NO: 534 - protein, 246 aa, Artificial Sequence
  Description of Artificial Sequence: Synthetic polypeptide
  XENP019783 [CTLA-4]_H0.39_L0_scFv(GKPGS)4
QVQLVESGGGVVQPGRSLRLSCAASGFTFSSYTMHWVRQAPGKGLEWVGFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 535 - protein, 118 aa, Artificial Sequence
  Description of Artificial Sequence: Synthetic polypeptide
  VH of XENP019783
QVQLVESGGGVVQPGRSLRLSCAASGFTFSSYTMHWVRQAPGKGLEWVGFISYDGNNKYYADSVKGRFTISRDNSKNTLYLQMNSLRAEDTAIYYCARTGWLGPFDYWGQGTLVTVSS

SEQ ID NO: 536 - protein, 108 aa, Artificial Sequence; identical to SEQ ID NO: 23
  Description of Artificial Sequence: Synthetic polypeptide
  VL of XENP019783

SEQ ID NO: 537 - protein, 5 aa, Artificial Sequence
  Description of Artificial Sequence: Synthetic peptide
  XENP019783 vhCDR1
SYTMH

SEQ ID NO: 538 - protein, 17 aa, Artificial Sequence
  Description of Artificial Sequence: Synthetic peptide
  XENP019783 vhCDR2
FISYDGNNKYYADSVKG

SEQ ID NO: 539 - protein, 9 aa, Artificial Sequence
  Description of Artificial Sequence: Synthetic peptide
  XENP019783 vhCDR3
TGWLGPFDY

SEQ ID NO: 540 - protein, 12 aa, Artificial Sequence
  Description of Artificial Sequence: Synthetic peptide
  XENP019783 vlCDR1
RASQSVGSSYLA

SEQ ID NO: 541 - protein, 7 aa, Artificial Sequence
  Description of Artificial Sequence: Synthetic peptide
  XENP019783 vlCDR2
GAFSRAT

SEQ ID NO: 542 - protein, 9 aa, Artificial Sequence
  Description of Artificial Sequence: Synthetic peptide
  XENP019783 vlCDR3
QQYGSSPWT

SEQ ID NO: 543 - protein, 246 aa, Artificial Sequence
  Description of Artificial Sequence: Synthetic polypeptide
  XENP019784 [CTLA-4]_H0.40_L0_scFv(GKPGS)4
QVQLVESGGGVVQPGRSLRLSCAASGFTFSSYTMHWVRQAPGKGLEWVSFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 544 - protein, 118 aa, Artificial Sequence
  Description of Artificial Sequence: Synthetic polypeptide
  VH of XENP019784
QVQLVESGGGVVQPGRSLRLSCAASGFTFSSYTMHWVRQAPGKGLEWVSFISYDGNNKYYADSVKGRFTISRDNSKNTLYLQMNSLRAEDTAIYYCARTGWLGPFDYWGQGTLVTVSS

SEQ ID NO: 545 - protein, 108 aa, Artificial Sequence; identical to SEQ ID NO: 23
  Description of Artificial Sequence: Synthetic polypeptide
  VL of XENP019784

SEQ ID NO: 546 - protein, 5 aa, Artificial Sequence
  Description of Artificial Sequence: Synthetic peptide
  XENP019784 vhCDR1
SYTMH

SEQ ID NO: 547 - protein, 17 aa, Artificial Sequence
  Description of Artificial Sequence: Synthetic peptide
  XENP019784 vhCDR2
FISYDGNNKYYADSVKG

SEQ ID NO: 548 - protein, 9 aa, Artificial Sequence
  Description of Artificial Sequence: Synthetic peptide
  XENP019784 vhCDR3
TGWLGPFDY

SEQ ID NO: 549 - protein, 12 aa, Artificial Sequence
  Description of Artificial Sequence: Synthetic peptide
  XENP019784 vlCDR1
RASQSVGSSYLA

SEQ ID NO: 550 - protein, 7 aa, Artificial Sequence
  Description of Artificial Sequence: Synthetic peptide
  XENP019784 vlCDR2
GAFSRAT

SEQ ID NO: 551 - protein, 9 aa, Artificial Sequence
  Description of Artificial Sequence: Synthetic peptide
  XENP019784 vlCDR3
QQYGSSPWT

SEQ ID NO: 552 - protein, 246 aa, Artificial Sequence
  Description of Artificial Sequence: Synthetic polypeptide
  XENP019785 [CTLA-4]_H0.41_L0_scFv(GKPGS)4
QVQLVESGGGVVQPGRSLRLSCAASGFTFSSYTMHWVRQAPGKGLEWVVFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 553 - protein, 118 aa, Artificial Sequence
  Description of Artificial Sequence: Synthetic polypeptide
  VH of XENP019785
QVQLVESGGGVVQPGRSLRLSCAASGFTFSSYTMHWVRQAPGKGLEWVVFISYDGNNKYYADSVKGRFTISRDNSKNTLYLQMNSLRAEDTAIYYCARTGWLGPFDYWGQGTLVTVSS

SEQ ID NO: 554 - protein, 108 aa, Artificial Sequence; identical to SEQ ID NO: 23
  Description of Artificial Sequence: Synthetic polypeptide
  VL of XENP019785

SEQ ID NO: 555 - protein, 5 aa, Artificial Sequence
  Description of Artificial Sequence: Synthetic peptide
  XENP019785 vhCDR1
SYTMH

SEQ ID NO: 556 - protein, 17 aa, Artificial Sequence
  Description of Artificial Sequence: Synthetic peptide
  XENP019785 vhCDR2
FISYDGNNKYYADSVKG

SEQ ID NO: 557 - protein, 9 aa, Artificial Sequence
  Description of Artificial Sequence: Synthetic peptide
  XENP019785 vhCDR3
TGWLGPFDY

SEQ ID NO: 558 - protein, 12 aa, Artificial Sequence
  Description of Artificial Sequence: Synthetic peptide
  XENP019785 vlCDR1
RASQSVGSSYLA

SEQ ID NO: 559 - protein, 7 aa, Artificial Sequence
  Description of Artificial Sequence: Synthetic peptide
  XENP019785 vlCDR2
GAFSRAT

SEQ ID NO: 560 - protein, 9 aa, Artificial Sequence
  Description of Artificial Sequence: Synthetic peptide
  XENP019785 vlCDR3
QQYGSSPWT

SEQ ID NO: 561 - protein, 246 aa, Artificial Sequence
  Description of Artificial Sequence: Synthetic polypeptide
  XENP019786 [CTLA-4]_H0.42_L0_scFv(GKPGS)4
QVQLVESGGGVVQPGRSLRLSCAASGFTFSSYTMHWVRQAPGKGLEWVTAISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 562 - protein, 118 aa, Artificial Sequence
  Description of Artificial Sequence: Synthetic polypeptide
  VH of XENP019786
QVQLVESGGGVVQPGRSLRLSCAASGFTFSSYTMHWVRQAPGKGLEWVTAISYDGNNKYYADSVKGRFTISRDNSKNTLYLQMNSLRAEDTAIYYCARTGWLGPFDYWGQGTLVTVSS

SEQ ID NO: 563 - protein, 108 aa, Artificial Sequence; identical to SEQ ID NO: 23
  Description of Artificial Sequence: Synthetic polypeptide
  VL of XENP019786

SEQ ID NO: 564 - protein, 5 aa, Artificial Sequence
  Description of Artificial Sequence: Synthetic peptide
  XENP019786 vhCDR1
SYTMH

SEQ ID NO: 565 - protein, 17 aa, Artificial Sequence
  Description of Artificial Sequence: Synthetic peptide
  XENP019786 vhCDR2
AISYDGNNKYYADSVKG

SEQ ID NO: 566 - protein, 9 aa, Artificial Sequence
  Description of Artificial Sequence: Synthetic peptide
  XENP019786 vhCDR3
TGWLGPFDY

SEQ ID NO: 567 - protein, 12 aa, Artificial Sequence
  Description of Artificial Sequence: Synthetic peptide
  XENP019786 vlCDR1
RASQSVGSSYLA

SEQ ID NO: 568 - protein, 7 aa, Artificial Sequence
  Description of Artificial Sequence: Synthetic peptide
  XENP019786 vlCDR2
GAFSRAT

SEQ ID NO: 569 - protein, 9 aa, Artificial Sequence
  Description of Artificial Sequence: Synthetic peptide
  XENP019786 vlCDR3
QQYGSSPWT

SEQ ID NO: 570 - protein, 246 aa, Artificial Sequence
  Description of Artificial Sequence: Synthetic polypeptide
  XENP019787 [CTLA-4]_H0.43_L0_scFv(GKPGS)4
QVQLVESGGGVVQPGRSLRLSCAASGFTFSSYTMHWVRQAPGKGLEWVTGISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 571 - protein, 118 aa, Artificial Sequence
  Description of Artificial Sequence: Synthetic polypeptide
  VH of XENP019787
QVQLVESGGGVVQPGRSLRLSCAASGFTFSSYTMHWVRQAPGKGLEWVTGISYDGNNKYYADSVKGRFTISRDNSKNTLYLQMNSLRAEDTAIYYCARTGWLGPFDYWGQGTLVTVSS

SEQ ID NO: 572 - protein, 108 aa, Artificial Sequence; identical to SEQ ID NO: 23
  Description of Artificial Sequence: Synthetic polypeptide
  VL of XENP019787

SEQ ID NO: 573 - protein, 5 aa, Artificial Sequence
  Description of Artificial Sequence: Synthetic peptide
  XENP019787 vhCDR1
SYTMH

SEQ ID NO: 574 - protein, 17 aa, Artificial Sequence
  Description of Artificial Sequence: Synthetic peptide
  XENP019787 vhCDR2
GISYDGNNKYYADSVKG

SEQ ID NO: 575 - protein, 9 aa, Artificial Sequence
  Description of Artificial Sequence: Synthetic peptide
  XENP019787 vhCDR3
TGWLGPFDY

SEQ ID NO: 576 - protein, 12 aa, Artificial Sequence
  Description of Artificial Sequence: Synthetic peptide
  XENP019787 vlCDR1
RASQSVGSSYLA

SEQ ID NO: 577 - protein, 7 aa, Artificial Sequence
  Description of Artificial Sequence: Synthetic peptide
  XENP019787 vlCDR2
GAFSRAT

SEQ ID NO: 578 - protein, 9 aa, Artificial Sequence
  Description of Artificial Sequence: Synthetic peptide
  XENP019787 vlCDR3
QQYGSSPWT

SEQ ID NO: 579 - protein, 246 aa, Artificial Sequence
  Description of Artificial Sequence: Synthetic polypeptide
  XENP019788 [CTLA-4]_H0.44_L0_scFv(GKPGS)4
QVQLVESGGGVVQPGRSLRLSCAASGFTFSSYTMHWVRQAPGKGLEWVTLISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 580 - protein, 118 aa, Artificial Sequence
  Description of Artificial Sequence: Synthetic polypeptide
  VH of XENP019788
QVQLVESGGGVVQPGRSLRLSCAASGFTFSSYTMHWVRQAPGKGLEWVTLISYDGNNKYYADSVKGRFTISRDNSKNTLYLQMNSLRAEDTAIYYCARTGWLGPFDYWGQGTLVTVSS

SEQ ID NO: 581 - protein, 108 aa, Artificial Sequence; identical to SEQ ID NO: 23
  Description of Artificial Sequence: Synthetic polypeptide
  VL of XENP019788

SEQ ID NO: 582 - protein, 5 aa, Artificial Sequence
  Description of Artificial Sequence: Synthetic peptide
  XENP019788 vhCDR1
SYTMH

SEQ ID NO: 583 - protein, 17 aa, Artificial Sequence
  Description of Artificial Sequence: Synthetic peptide
  XENP019788 vhCDR2
LISYDGNNKYYADSVKG

SEQ ID NO: 584 - protein, 9 aa, Artificial Sequence
  Description of Artificial Sequence: Synthetic peptide
  XENP019788 vhCDR3
TGWLGPFDY

SEQ ID NO: 585 - protein, 12 aa, Artificial Sequence
  Description of Artificial Sequence: Synthetic peptide
  XENP019788 vlCDR1
RASQSVGSSYLA

SEQ ID NO: 586 - protein, 7 aa, Artificial Sequence
  Description of Artificial Sequence: Synthetic peptide
  XENP019788 vlCDR2
GAFSRAT

SEQ ID NO: 587 - protein, 9 aa, Artificial Sequence
  Description of Artificial Sequence: Synthetic peptide
  XENP019788 vlCDR3
QQYGSSPWT

SEQ ID NO: 588 - protein, 246 aa, Artificial Sequence
  Description of Artificial Sequence: Synthetic polypeptide
  XENP019789 [CTLA-4]_H0.45_L0_scFv(GKPGS)4
QVQLVESGGGVVQPGRSLRLSCAASGFTFSSYTMHWVRQAPGKGLEWVTIISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 589 - protein, 118 aa, Artificial Sequence
  Description of Artificial Sequence: Synthetic polypeptide
  VH of XENP019789
QVQLVESGGGVVQPGRSLRLSCAASGFTFSSYTMHWVRQAPGKGLEWVTIISYDGNNKYYADSVKGRFTISRDNSKNTLYLQMNSLRAEDTAIYYCARTGWLGPFDYWGQGTLVTVSS

SEQ ID NO: 590 - protein, 108 aa, Artificial Sequence; identical to SEQ ID NO: 23
  Description of Artificial Sequence: Synthetic polypeptide
  VL of XENP019789

SEQ ID NO: 591 - protein, 5 aa, Artificial Sequence
  Description of Artificial Sequence: Synthetic peptide
  XENP019789 vhCDR1
SYTMH

SEQ ID NO: 592 - protein, 17 aa, Artificial Sequence
  Description of Artificial Sequence: Synthetic peptide
  XENP019789 vhCDR2
IISYDGNNKYYADSVKG

SEQ ID NO: 593 - protein, 9 aa, Artificial Sequence
  Description of Artificial Sequence: Synthetic peptide
  XENP019789 vhCDR3
TGWLGPFDY

SEQ ID NO: 594 - protein, 12 aa, Artificial Sequence
  Description of Artificial Sequence: Synthetic peptide
  XENP019789 vlCDR1
RASQSVGSSYLA

SEQ ID NO: 595 - protein, 7 aa, Artificial Sequence
  Description of Artificial Sequence: Synthetic peptide
  XENP019789 vlCDR2
GAFSRAT

SEQ ID NO: 596 - protein, 9 aa, Artificial Sequence
  Description of Artificial Sequence: Synthetic peptide
  XENP019789 vlCDR3
QQYGSSPWT

SEQ ID NO: 597 - protein, 246 aa, Artificial Sequence
  Description of Artificial Sequence: Synthetic polypeptide
  XENP019790 [CTLA-4]_H0.46_L0_scFv(GKPGS)4
QVQLVESGGGVVQPGRSLRLSCAASGFTFSSYTMHWVRQAPGKGLEWVTRISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 598 - protein, 118 aa, Artificial Sequence
  Description of Artificial Sequence: Synthetic polypeptide
  VH of XENP019790
QVQLVESGGGVVQPGRSLRLSCAASGFTFSSYTMHWVRQAPGKGLEWVTRISYDGNNKYYADSVKGRFTISRDNSKNTLYLQMNSLRAEDTAIYYCARTGWLGPFDYWGQGTLVTVSS

SEQ ID NO: 599 - protein, 108 aa, Artificial Sequence; identical to SEQ ID NO: 23
  Description of Artificial Sequence: Synthetic polypeptide
  VL of XENP019790

SEQ ID NO: 600 - protein, 5 aa, Artificial Sequence
  Description of Artificial Sequence: Synthetic peptide
  XENP019790 vhCDR1
SYTMH

SEQ ID NO: 601 - protein, 17 aa, Artificial Sequence
  Description of Artificial Sequence: Synthetic peptide
  XENP019790 vhCDR2
RISYDGNNKYYADSVKG

SEQ ID NO: 602 - protein, 9 aa, Artificial Sequence
  Description of Artificial Sequence: Synthetic peptide
  XENP019790 vhCDR3
TGWLGPFDY

SEQ ID NO: 603 - protein, 12 aa, Artificial Sequence
  Description of Artificial Sequence: Synthetic peptide
  XENP019790 vlCDR1
RASQSVGSSYLA

SEQ ID NO: 604 - protein, 7 aa, Artificial Sequence
  Description of Artificial Sequence: Synthetic peptide
  XENP019790 vlCDR2
GAFSRAT

SEQ ID NO: 605 - protein, 9 aa, Artificial Sequence
  Description of Artificial Sequence: Synthetic peptide
  XENP019790 vlCDR3
QQYGSSPWT

SEQ ID NO: 606 - protein, 246 aa, Artificial Sequence
  Description of Artificial Sequence: Synthetic polypeptide
  XENP019791 [CTLA-4]_H0.47_L0_scFv(GKPGS)4
QVQLVESGGGVVQPGRSLRLSCAASGFTFSSYTMHWVRQAPGKGLEWVTVISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 607 - protein, 118 aa, Artificial Sequence
  Description of Artificial Sequence: Synthetic polypeptide
  VH of XENP019791
QVQLVESGGGVVQPGRSLRLSCAASGFTFSSYTMHWVRQAPGKGLEWVTVISYDGNNKYYADSVKGRFTISRDNSKNTLYLQMNSLRAEDTAIYYCARTGWLGPFDYWGQGTLVTVSS

SEQ ID NO: 608 - protein, 108 aa, Artificial Sequence; identical to SEQ ID NO: 23
  Description of Artificial Sequence: Synthetic polypeptide
  VL of XENP019791

SEQ ID NO: 609 - protein, 5 aa, Artificial Sequence
  Description of Artificial Sequence: Synthetic peptide
  XENP019791 vhCDR1
SYTMH

SEQ ID NO: 610 - protein, 17 aa, Artificial Sequence
  Description of Artificial Sequence: Synthetic peptide
  XENP019791 vhCDR2
VISYDGNNKYYADSVKG

SEQ ID NO: 611 - protein, 9 aa, Artificial Sequence
  Description of Artificial Sequence: Synthetic peptide
  XENP019791 vhCDR3
TGWLGPFDY

SEQ ID NO: 612 - protein, 12 aa, Artificial Sequence
  Description of Artificial Sequence: Synthetic peptide
  XENP019791 vlCDR1
RASQSVGSSYLA

SEQ ID NO: 613 - protein, 7 aa, Artificial Sequence
  Description of Artificial Sequence: Synthetic peptide
  XENP019791 vlCDR2
GAFSRAT

SEQ ID NO: 614 - protein, 9 aa, Artificial Sequence
  Description of Artificial Sequence: Synthetic peptide
  XENP019791 vlCDR3
QQYGSSPWT

SEQ ID NO: 615 - protein, 246 aa, Artificial Sequence
  Description of Artificial Sequence: Synthetic polypeptide
  XENP019792 [CTLA-4]_H0.48_L0_scFv(GKPGS)4
QVQLVESGGGVVQPGRSLRLSCAASGFTFSSYTMHWVRQAPGKGLEWVTYISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 616 - protein, 118 aa, Artificial Sequence
  Description of Artificial Sequence: Synthetic polypeptide
  VH of XENP019792
QVQLVESGGGVVQPGRSLRLSCAASGFTFSSYTMHWVRQAPGKGLEWVTYISYDGNNKYYADSVKGRFTISRDNSKNTLYLQMNSLRAEDTAIYYCARTGWLGPFDYWGQGTLVTVSS

SEQ ID NO: 617 - protein, 108 aa, Artificial Sequence; identical to SEQ ID NO: 23
  Description of Artificial Sequence: Synthetic polypeptide
  VL of XENP019792

SEQ ID NO: 618 - protein, 5 aa, Artificial Sequence
  Description of Artificial Sequence: Synthetic peptide
  XENP019792 vhCDR1
SYTMH

SEQ ID NO: 619 - protein, 17 aa, Artificial Sequence
  Description of Artificial Sequence: Synthetic peptide
  XENP019792 vhCDR2
YISYDGNNKYYADSVKG

SEQ ID NO: 620 - protein, 9 aa, Artificial Sequence
  Description of Artificial Sequence: Synthetic peptide
  XENP019792 vhCDR3
TGWLGPFDY

SEQ ID NO: 621 - protein, 12 aa, Artificial Sequence
  Description of Artificial Sequence: Synthetic peptide
  XENP019792 vlCDR1
RASQSVGSSYLA

SEQ ID NO: 622 - protein, 7 aa, Artificial Sequence
  Description of Artificial Sequence: Synthetic peptide
  XENP019792 vlCDR2
GAFSRAT

SEQ ID NO: 623 - protein, 9 aa, Artificial Sequence
  Description of Artificial Sequence: Synthetic peptide
  XENP019792 vlCDR3
QQYGSSPWT

SEQ ID NO: 624 - protein, 246 aa, Artificial Sequence
  Description of Artificial Sequence: Synthetic polypeptide
  XENP019793 [CTLA-4]_H0.49_L0_scFv(GKPGS)4
QVQLVESGGGVVQPGRSLRLSCAASGFTFSSYTMHWVRQAPGKGLEWVTFESYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 625 - protein, 118 aa, Artificial Sequence
  Description of Artificial Sequence: Synthetic polypeptide
  VH of XENP019793
QVQLVESGGGVVQPGRSLRLSCAASGFTFSSYTMHWVRQAPGKGLEWVTFESYDGNNKYYADSVKGRFTISRDNSKNTLYLQMNSLRAEDTAIYYCARTGWLGPFDYWGQGTLVTVSS

SEQ ID NO: 626 - protein, 108 aa, Artificial Sequence; identical to SEQ ID NO: 23
  Description of Artificial Sequence: Synthetic polypeptide
  VL of XENP019793

SEQ ID NO: 627 - protein, 5 aa, Artificial Sequence
  Description of Artificial Sequence: Synthetic peptide
  XENP019793 vhCDR1
SYTMH

SEQ ID NO: 628 - protein, 17 aa, Artificial Sequence
  Description of Artificial Sequence: Synthetic peptide
  XENP019793 vhCDR2
FESYDGNNKYYADSVKG

SEQ ID NO: 629 - protein, 9 aa, Artificial Sequence
  Description of Artificial Sequence: Synthetic peptide
  XENP019793 vhCDR3
TGWLGPFDY

SEQ ID NO: 630 - protein, 12 aa, Artificial Sequence
  Description of Artificial Sequence: Synthetic peptide
  XENP019793 vlCDR1
RASQSVGSSYLA

SEQ ID NO: 631 - protein, 7 aa, Artificial Sequence
  Description of Artificial Sequence: Synthetic peptide
  XENP019793 vlCDR2
GAFSRAT

SEQ ID NO: 632 - protein, 9 aa, Artificial Sequence
  Description of Artificial Sequence: Synthetic peptide
  XENP019793 vlCDR3
QQYGSSPWT

SEQ ID NO: 633 - protein, 246 aa, Artificial Sequence
  Description of Artificial Sequence: Synthetic polypeptide
  XENP019794 [CTLA-4]_H0.50_L0_scFv(GKPGS)4
QVQLVESGGGVVQPGRSLRLSCAASGFTFSSYTMHWVRQAPGKGLEWVTFHSYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 634 - protein, 118 aa, Artificial Sequence
  Description of Artificial Sequence: Synthetic polypeptide
  VH of XENP019794
QVQLVESGGGVVQPGRSLRLSCAASGFTFSSYTMHWVRQAPGKGLEWVTFHSYDGNNKYYADSVKGRFTISRDNSKNTLYLQMNSLRAEDTAIYYCARTGWLGPFDYWGQGTLVTVSS

SEQ ID NO: 635 - protein, 108 aa, Artificial Sequence; identical to SEQ ID NO: 23
  Description of Artificial Sequence: Synthetic polypeptide
  VL of XENP019794

SEQ ID NO: 636 - protein, 5 aa, Artificial Sequence
  Description of Artificial Sequence: Synthetic peptide
  XENP019794 vhCDR1
SYTMH

SEQ ID NO: 637 - protein, 17 aa, Artificial Sequence
  Description of Artificial Sequence: Synthetic peptide
  XENP019794 vhCDR2
FHSYDGNNKYYADSVKG

SEQ ID NO: 638 - protein, 9 aa, Artificial Sequence
  Description of Artificial Sequence: Synthetic peptide
  XENP019794 vhCDR3
TGWLGPFDY

SEQ ID NO: 639 - protein, 12 aa, Artificial Sequence
  Description of Artificial Sequence: Synthetic peptide
  XENP019794 vlCDR1
RASQSVGSSYLA

SEQ ID NO: 640 - protein, 7 aa, Artificial Sequence
  Description of Artificial Sequence: Synthetic peptide
  XENP019794 vlCDR2
GAFSRAT

SEQ ID NO: 641 - protein, 9 aa, Artificial Sequence
  Description of Artificial Sequence: Synthetic peptide
  XENP019794 vlCDR3
QQYGSSPWT

SEQ ID NO: 642 - protein, 246 aa, Artificial Sequence
  Description of Artificial Sequence: Synthetic polypeptide
  XENP019795 [CTLA-4]_H0.51_L0_scFv(GKPGS)4
QVQLVESGGGVVQPGRSLRLSCAASGFTFSSYTMHWVRQAPGKGLEWVTFTSYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 643 - protein, 118 aa, Artificial Sequence
  Description of Artificial Sequence: Synthetic polypeptide
  VH of XENP019795
QVQLVESGGGVVQPGRSLRLSCAASGFTFSSYTMHWVRQAPGKGLEWVTFTSYDGNNKYYADSVKGRFTISRDNSKNTLYLQMNSLRAEDTAIYYCARTGWLGPFDYWGQGTLVTVSS

SEQ ID NO: 644 - protein, 108 aa, Artificial Sequence; identical to SEQ ID NO: 23
  Description of Artificial Sequence: Synthetic polypeptide
  VL of XENP019795

SEQ ID NO: 645 - protein, 5 aa, Artificial Sequence
  Description of Artificial Sequence: Synthetic peptide
  XENP019795 vhCDR1
SYTMH

SEQ ID NO: 646 - protein, 17 aa, Artificial Sequence
  Description of Artificial Sequence: Synthetic peptide
  XENP019795 vhCDR2
FTSYDGNNKYYADSVKG

SEQ ID NO: 647 - protein, 9 aa, Artificial Sequence
  Description of Artificial Sequence: Synthetic peptide
  XENP019795 vhCDR3
TGWLGPFDY

SEQ ID NO: 648 - protein, 12 aa, Artificial Sequence
  Description of Artificial Sequence: Synthetic peptide
  XENP019795 vlCDR1
RASQSVGSSYLA

SEQ ID NO: 649 - protein, 7 aa, Artificial Sequence
  Description of Artificial Sequence: Synthetic peptide
  XENP019795 vlCDR2
GAFSRAT

SEQ ID NO: 650 - protein, 9 aa, Artificial Sequence
  Description of Artificial Sequence: Synthetic peptide
  XENP019795 vlCDR3
QQYGSSPWT

SEQ ID NO: 651 - protein, 246 aa, Artificial Sequence
  Description of Artificial Sequence: Synthetic polypeptide
  XENP019796 [CTLA-4]_H0.52_L0_scFv(GKPGS)4
QVQLVESGGGVVQPGRSLRLSCAASGFTFSSYTMHWVRQAPGKGLEWVTFVSYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 652 - protein, 118 aa, Artificial Sequence
  Description of Artificial Sequence: Synthetic polypeptide
  VH of XENP019796
QVQLVESGGGVVQPGRSLRLSCAASGFTFSSYTMHWVRQAPGKGLEWVTFVSYDGNNKYYADSVKGRFTISRDNSKNTLYLQMNSLRAEDTAIYYCARTGWLGPFDYWGQGTLVTVSS

SEQ ID NO: 653 - protein, 108 aa, Artificial Sequence; identical to SEQ ID NO: 23
  Description of Artificial Sequence: Synthetic polypeptide
  VL of XENP019796

SEQ ID NO: 654 - protein, 5 aa, Artificial Sequence
  Description of Artificial Sequence: Synthetic peptide
  XENP019796 vhCDR1
SYTMH

SEQ ID NO: 655 - protein, 17 aa, Artificial Sequence
  Description of Artificial Sequence: Synthetic peptide
  XENP019796 vhCDR2
FVSYDGNNKYYADSVKG

SEQ ID NO: 656 - protein, 9 aa, Artificial Sequence
  Description of Artificial Sequence: Synthetic peptide
  XENP019796 vhCDR3
TGWLGPFDY

SEQ ID NO: 657 - protein, 12 aa, Artificial Sequence
  Description of Artificial Sequence: Synthetic peptide
  XENP019796 vlCDR1
RASQSVGSSYLA

SEQ ID NO: 658 - protein, 7 aa, Artificial Sequence
  Description of Artificial Sequence: Synthetic peptide
  XENP019796 vlCDR2
GAFSRAT

SEQ ID NO: 659 - protein, 9 aa, Artificial Sequence
  Description of Artificial Sequence: Synthetic peptide
  XENP019796 vlCDR3
QQYGSSPWT

SEQ ID NO: 660 - protein, 246 aa, Artificial Sequence
  Description of Artificial Sequence: Synthetic polypeptide
  XENP019801 [CTLA-4]_H0.53_L0_scFv(GKPGS)4
QVQLVESGGGVVQPGRSLRLSCAASGFTFSSYTMHWVRQAPGKGLEWVTFYSYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 661 - protein, 118 aa, Artificial Sequence
  Description of Artificial Sequence: Synthetic polypeptide
  VH of XENP019801
QVQLVESGGGVVQPGRSLRLSCAASGFTFSSYTMHWVRQAPGKGLEWVTFYSYDGNNKYYADSVKGRFTISRDNSKNTLYLQMNSLRAEDTAIYYCARTGWLGPFDYWGQGTLVTVSS

SEQ ID NO: 662 - protein, 108 aa, Artificial Sequence; identical to SEQ ID NO: 23
  Description of Artificial Sequence: Synthetic polypeptide
  VL of XENP019801

SEQ ID NO: 663 - protein, 5 aa, Artificial Sequence
  Description of Artificial Sequence: Synthetic peptide
  XENP019801 vhCDR1
SYTMH

SEQ ID NO: 664 - protein, 17 aa, Artificial Sequence
  Description of Artificial Sequence: Synthetic peptide
  XENP019801 vhCDR2
FYSYDGNNKYYADSVKG

SEQ ID NO: 665 - protein, 9 aa, Artificial Sequence
  Description of Artificial Sequence: Synthetic peptide
  XENP019801 vhCDR3
TGWLGPFDY

SEQ ID NO: 666 - protein, 12 aa, Artificial Sequence
  Description of Artificial Sequence: Synthetic peptide
  XENP019801 vlCDR1
RASQSVGSSYLA

SEQ ID NO: 667 - protein, 7 aa, Artificial Sequence
  Description of Artificial Sequence: Synthetic peptide
  XENP019801 vlCDR2
GAFSRAT

SEQ ID NO: 668 - protein, 9 aa, Artificial Sequence
  Description of Artificial Sequence: Synthetic peptide
  XENP019801 vlCDR3
QQYGSSPWT

SEQ ID NO: 669 - protein, 246 aa, Artificial Sequence
  Description of Artificial Sequence: Synthetic polypeptide
  XENP019802 [CTLA-4]_H0.54_L0_scFv(GKPGS)4
QVQLVESGGGVVQPGRSLRLSCAASGFTFSSYTMHWVRQAPGKGLEWVTFISGDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 670 - protein, 118 aa, Artificial Sequence
  Description of Artificial Sequence: Synthetic polypeptide
  VH of XENP019802
QVQLVESGGGVVQPGRSLRLSCAASGFTFSSYTMHWVRQAPGKGLEWVTFISGDGNNKYYADSVKGRFTISRDNSKNTLYLQMNSLRAEDTAIYYCARTGWLGPFDYWGQGTLVTVSS

SEQ ID NO: 671 - protein, 108 aa, Artificial Sequence; identical to SEQ ID NO: 23
  Description of Artificial Sequence: Synthetic polypeptide
  VL of XENP019802

SEQ ID NO: 672 - protein, 5 aa, Artificial Sequence
  Description of Artificial Sequence: Synthetic peptide
  XENP019802 vhCDR1
SYTMH

SEQ ID NO: 673 - protein, 17 aa, Artificial Sequence
  Description of Artificial Sequence: Synthetic peptide
  XENP019802 vhCDR2
FISGDGNNKYYADSVKG

SEQ ID NO: 674 - protein, 9 aa, Artificial Sequence
  Description of Artificial Sequence: Synthetic peptide
  XENP019802 vhCDR3
TGWLGPFDY

SEQ ID NO: 675 - protein, 12 aa, Artificial Sequence
  Description of Artificial Sequence: Synthetic peptide
  XENP019802 vlCDR1
RASQSVGSSYLA

SEQ ID NO: 676 - protein, 7 aa, Artificial Sequence
  Description of Artificial Sequence: Synthetic peptide
  XENP019802 vlCDR2
GAFSRAT

SEQ ID NO: 677 - protein, 9 aa, Artificial Sequence
  Description of Artificial Sequence: Synthetic peptide
  XENP019802 vlCDR3
QQYGSSPWT

SEQ ID NO: 678 - protein, 246 aa, Artificial Sequence
  Description of Artificial Sequence: Synthetic polypeptide
  XENP019803 [CTLA-4]_H0.55_L0_scFv(GKPGS)4
QVQLVESGGGVVQPGRSLRLSCAASGFTFSSYTMHWVRQAPGKGLEWVTFISNDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 679 - protein, 118 aa, Artificial Sequence
  Description of Artificial Sequence: Synthetic polypeptide
  VH of XENP019803
QVQLVESGGGVVQPGRSLRLSCAASGFTFSSYTMHWVRQAPGKGLEWVTFISNDGNNKYYADSVKGRFTISRDNSKNTLYLQMNSLRAEDTAIYYCARTGWLGPFDYWGQGTLVTVSS

SEQ ID NO: 680 - protein, 108 aa, Artificial Sequence; identical to SEQ ID NO: 23
  Description of Artificial Sequence: Synthetic polypeptide
  VL of XENP019803

SEQ ID NO: 681 - protein, 5 aa, Artificial Sequence
  Description of Artificial Sequence: Synthetic peptide
  XENP019803 vhCDR1
SYTMH

SEQ ID NO: 682 - protein, 17 aa, Artificial Sequence
  Description of Artificial Sequence: Synthetic peptide
  XENP019803 vhCDR2
FISNDGNNKYYADSVKG

SEQ ID NO: 683 - protein, 9 aa, Artificial Sequence
  Description of Artificial Sequence: Synthetic peptide
  XENP019803 vhCDR3
TGWLGPFDY

SEQ ID NO: 684 - protein, 12 aa, Artificial Sequence
  Description of Artificial Sequence: Synthetic peptide
  XENP019803 vlCDR1
RASQSVGSSYLA

SEQ ID NO: 685 - protein, 7 aa, Artificial Sequence
  Description of Artificial Sequence: Synthetic peptide
  XENP019803 vlCDR2
GAFSRAT

SEQ ID NO: 686 - protein, 9 aa, Artificial Sequence
  Description of Artificial Sequence: Synthetic peptide
  XENP019803 vlCDR3
QQYGSSPWT

SEQ ID NO: 687 - protein, 246 aa, Artificial Sequence
  Description of Artificial Sequence: Synthetic polypeptide
  XENP019804 [CTLA-4]_H0.56_L0_scFv(GKPGS)4
QVQLVESGGGVVQPGRSLRLSCAASGFTFSSYTMHWVRQAPGKGLEWVTFISSDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 688 - protein, 118 aa, Artificial Sequence
  Description of Artificial Sequence: Synthetic polypeptide
  VH of XENP019804
QVQLVESGGGVVQPGRSLRLSCAASGFTFSSYTMHWVRQAPGKGLEWVTFISSDGNNKYYADSVKGRFTISRDNSKNTLYLQMNSLRAEDTAIYYCARTGWLGPFDYWGQGTLVTVSS

SEQ ID NO: 689 - protein, 108 aa, Artificial Sequence; identical to SEQ ID NO: 23
  Description of Artificial Sequence: Synthetic polypeptide
  VL of XENP019804

SEQ ID NO: 690 - protein, 5 aa, Artificial Sequence
  Description of Artificial Sequence: Synthetic peptide
  XENP019804 vhCDR1
SYTMH

SEQ ID NO: 691 - protein, 17 aa, Artificial Sequence
  Description of Artificial Sequence: Synthetic peptide
  XENP019804 vhCDR2
FISSDGNNKYYADSVKG

SEQ ID NO: 692 - protein, 9 aa, Artificial Sequence
  Description of Artificial Sequence: Synthetic peptide
  XENP019804 vhCDR3
TGWLGPFDY

SEQ ID NO: 693 - protein, 12 aa, Artificial Sequence
  Description of Artificial Sequence: Synthetic peptide
  XENP019804 vlCDR1
RASQSVGSSYLA

SEQ ID NO: 694 - protein, 7 aa, Artificial Sequence
  Description of Artificial Sequence: Synthetic peptide
  XENP019804 vlCDR2
GAFSRAT

SEQ ID NO: 695 - protein, 9 aa, Artificial Sequence
  Description of Artificial Sequence: Synthetic peptide
  XENP019804 vlCDR3
QQYGSSPWT

SEQ ID NO: 696 - protein, 246 aa, Artificial Sequence
  Description of Artificial Sequence: Synthetic polypeptide
  XENP019805 [CTLA-4]_H0.57_L0_scFv(GKPGS)4
QVQLVESGGGVVQPGRSLRLSCAASGFTFSSYTMHWVRQAPGKGLEWVTFISYNGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 697 - protein, 118 aa, Artificial Sequence
  Description of Artificial Sequence: Synthetic polypeptide
  VH of XENP019805
QVQLVESGGGVVQPGRSLRLSCAASGFTFSSYTMHWVRQAPGKGLEWVTFISYNGNNKYYADSVKGRFTISRDNSKNTLYLQMNSLRAEDTAIYYCARTGWLGPFDYWGQGTLVTVSS

SEQ ID NO: 698 - protein, 108 aa, Artificial Sequence; identical to SEQ ID NO: 23
  Description of Artificial Sequence: Synthetic polypeptide
  VL of XENP019805

SEQ ID NO: 699 - protein, 5 aa, Artificial Sequence
  Description of Artificial Sequence: Synthetic peptide
  XENP019805 vhCDR1
SYTMH

SEQ ID NO: 700 - protein, 17 aa, Artificial Sequence
  Description of Artificial Sequence: Synthetic peptide
  XENP019805 vhCDR2
FISYNGNNKYYADSVKG

SEQ ID NO: 701 - protein, 9 aa, Artificial Sequence
  Description of Artificial Sequence: Synthetic peptide
  XENP019805 vhCDR3
TGWLGPFDY

SEQ ID NO: 702 - protein, 12 aa, Artificial Sequence
  Description of Artificial Sequence: Synthetic peptide
  XENP019805 vlCDR1
RASQSVGSSYLA

SEQ ID NO: 703 - protein, 7 aa, Artificial Sequence
  Description of Artificial Sequence: Synthetic peptide
  XENP019805 vlCDR2
GAFSRAT

SEQ ID NO: 704 - protein, 9 aa, Artificial Sequence
  Description of Artificial Sequence: Synthetic peptide
  XENP019805 vlCDR3
QQYGSSPWT

SEQ ID NO: 705 - protein, 246 aa, Artificial Sequence
  Description of Artificial Sequence: Synthetic polypeptide
  XENP019806 [CTLA-4]_H0.58_L0_scFv(GKPGS)4
QVQLVESGGGVVQPGRSLRLSCAASGFTFSSYTMHWVRQAPGKGLEWVTFISYSGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 706 - protein, 118 aa, Artificial Sequence
  Description of Artificial Sequence: Synthetic polypeptide
  VH of XENP019806
QVQLVESGGGVVQPGRSLRLSCAASGFTFSSYTMHWVRQAPGKGLEWVTFISYSGNNKYYADSVKGRFTISRDNSKNTLYLQMNSLRAEDTAIYYCARTGWLGPFDYWGQGTLVTVSS

SEQ ID NO: 707 - protein, 108 aa, Artificial Sequence; identical to SEQ ID NO: 23
  Description of Artificial Sequence: Synthetic polypeptide
  VL of XENP019806

SEQ ID NO: 708 - protein, 5 aa, Artificial Sequence
  Description of Artificial Sequence: Synthetic peptide
  XENP019806 vhCDR1
SYTMH

SEQ ID NO: 709 - protein, 17 aa, Artificial Sequence
  Description of Artificial Sequence: Synthetic peptide
  XENP019806 vhCDR2
FISYSGNNKYYADSVKG

SEQ ID NO: 710 - protein, 9 aa, Artificial Sequence
  Description of Artificial Sequence: Synthetic peptide
  XENP019806 vhCDR3
TGWLGPFDY

SEQ ID NO: 711 - protein, 12 aa, Artificial Sequence
  Description of Artificial Sequence: Synthetic peptide
  XENP019806 vlCDR1
RASQSVGSSYLA

SEQ ID NO: 712 - protein, 7 aa, Artificial Sequence
  Description of Artificial Sequence: Synthetic peptide
  XENP019806 vlCDR2
GAFSRAT

SEQ ID NO: 713 - protein, 9 aa, Artificial Sequence
  Description of Artificial Sequence: Synthetic peptide
  XENP019806 vlCDR3
QQYGSSPWT

SEQ ID NO: 714 - protein, 246 aa, Artificial Sequence
  Description of Artificial Sequence: Synthetic polypeptide
  XENP019807 [CTLA-4]_H0.59_L0_scFv(GKPGS)4
QVQLVESGGGVVQPGRSLRLSCAASGFTFSSYTMHWVRQAPGKGLEWVTFISYEGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 715 - protein, 118 aa, Artificial Sequence
  Description of Artificial Sequence: Synthetic polypeptide
  VH of XENP019807
QVQLVESGGGVVQPGRSLRLSCAASGFTFSSYTMHWVRQAPGKGLEWVTFISYEGNNKYYADSVKGRFTISRDNSKNTLYLQMNSLRAEDTAIYYCARTGWLGPFDYWGQGTLVTVSS

SEQ ID NO: 716 - protein, 108 aa, Artificial Sequence; identical to SEQ ID NO: 23
  Description of Artificial Sequence: Synthetic polypeptide
  VL of XENP019807

SEQ ID NO: 717 - protein, 5 aa, Artificial Sequence
  Description of Artificial Sequence: Synthetic peptide
  XENP019807 vhCDR1
SYTMH

SEQ ID NO: 718 - protein, 17 aa, Artificial Sequence
  Description of Artificial Sequence: Synthetic peptide
  XENP019807 vhCDR2
FISYEGNNKYYADSVKG

SEQ ID NO: 719 - protein, 9 aa, Artificial Sequence
  Description of Artificial Sequence: Synthetic peptide
  XENP019807 vhCDR3
TGWLGPFDY

SEQ ID NO: 720 - protein, 12 aa, Artificial Sequence
  Description of Artificial Sequence: Synthetic peptide
  XENP019807 vlCDR1
RASQSVGSSYLA

SEQ ID NO: 721 - protein, 7 aa, Artificial Sequence
  Description of Artificial Sequence: Synthetic peptide
  XENP019807 vlCDR2
GAFSRAT

SEQ ID NO: 722 - protein, 9 aa, Artificial Sequence
  Description of Artificial Sequence: Synthetic peptide
  XENP019807 vlCDR3
QQYGSSPWT

SEQ ID NO: 723 - protein, 246 aa, Artificial Sequence
  Description of Artificial Sequence: Synthetic polypeptide
  XENP019808 [CTLA-4]_H0.60_L0_scFv(GKPGS)4
QVQLVESGGGVVQPGRSLRLSCAASGFTFSSYTMHWVRQAPGKGLEWVTFISYHGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 724 - protein, 118 aa, Artificial Sequence
  Description of Artificial Sequence: Synthetic polypeptide
  VH of XENP019808
QVQLVESGGGVVQPGRSLRLSCAASGFTFSSYTMHWVRQAPGKGLEWVTFISYHGNNKYYADSVKGRFTISRDNSKNTLYLQMNSLRAEDTAIYYCARTGWLGPFDYWGQGTLVTVSS

SEQ ID NO: 725 - protein, 108 aa, Artificial Sequence; identical to SEQ ID NO: 23
  Description of Artificial Sequence: Synthetic polypeptide
  VL of XENP019808

SEQ ID NO: 726 - protein, 5 aa, Artificial Sequence
  Description of Artificial Sequence: Synthetic peptide
  XENP019808 vhCDR1
SYTMH

SEQ ID NO: 727 - protein, 17 aa, Artificial Sequence
  Description of Artificial Sequence: Synthetic peptide
  XENP019808 vhCDR2
FISYHGNNKYYADSVKG

SEQ ID NO: 728 - protein, 9 aa, Artificial Sequence
  Description of Artificial Sequence: Synthetic peptide
  XENP019808 vhCDR3
TGWLGPFDY

SEQ ID NO: 729 - protein, 12 aa, Artificial Sequence
  Description of Artificial Sequence: Synthetic peptide
  XENP019808 vlCDR1
RASQSVGSSYLA

SEQ ID NO: 730 - protein, 7 aa, Artificial Sequence
  Description of Artificial Sequence: Synthetic peptide
  XENP019808 vlCDR2
GAFSRAT

SEQ ID NO: 731 - protein, 9 aa, Artificial Sequence
  Description of Artificial Sequence: Synthetic peptide
  XENP019808 vlCDR3
QQYGSSPWT

SEQ ID NO: 732 - protein, 246 aa, Artificial Sequence
  Description of Artificial Sequence: Synthetic polypeptide
  XENP019809 [CTLA-4]_H0.61_L0_scFv(GKPGS)4
QVQLVESGGGVVQPGRSLRLSCAASGFTFSSYTMHWVRQAPGKGLEWVTFISYKGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 733 - protein, 118 aa, Artificial Sequence
  Description of Artificial Sequence: Synthetic polypeptide
  VH of XENP019809
QVQLVESGGGVVQPGRSLRLSCAASGFTFSSYTMHWVRQAPGKGLEWVTFISYKGNNKYYADSVKGRFTISRDNSKNTLYLQMNSLRAEDTAIYYCARTGWLGPFDYWGQGTLVTVSS

SEQ ID NO: 734 - protein, 108 aa, Artificial Sequence; identical to SEQ ID NO: 23
  Description of Artificial Sequence: Synthetic polypeptide
  VL of XENP019809

SEQ ID NO: 735 - protein, 5 aa, Artificial Sequence
  Description of Artificial Sequence: Synthetic peptide
  XENP019809 vhCDR1
SYTMH

SEQ ID NO: 736 - protein, 17 aa, Artificial Sequence
  Description of Artificial Sequence: Synthetic peptide
  XENP019809 vhCDR2
FISYKGNNKYYADSVKG

SEQ ID NO: 737 - protein, 9 aa, Artificial Sequence
  Description of Artificial Sequence: Synthetic peptide
  XENP019809 vhCDR3
TGWLGPFDY

SEQ ID NO: 738 - protein, 12 aa, Artificial Sequence
  Description of Artificial Sequence: Synthetic peptide
  XENP019809 vlCDR1
RASQSVGSSYLA

SEQ ID NO: 739 - protein, 7 aa, Artificial Sequence
  Description of Artificial Sequence: Synthetic peptide
  XENP019809 vlCDR2
GAFSRAT

SEQ ID NO: 740 - protein, 9 aa, Artificial Sequence
  Description of Artificial Sequence: Synthetic peptide
  XENP019809 vlCDR3
QQYGSSPWT

SEQ ID NO: 741 - protein, 246 aa, Artificial Sequence
  Description of Artificial Sequence: Synthetic polypeptide
  XENP019810 [CTLA-4]_H0.62_L0_scFv(GKPGS)4
QVQLVESGGGVVQPGRSLRLSCAASGFTFSSYTMHWVRQAPGKGLEWVTFISYKGNNKYYADSVKGRFTISEDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 742 - protein, 118 aa, Artificial Sequence
  Description of Artificial Sequence: Synthetic polypeptide
  VH of XENP019810
QVQLVESGGGVVQPGRSLRLSCAASGFTFSSYTMHWVRQAPGKGLEWVTFISYKGNNKYYADSVKGRFTISEDNSKNTLYLQMNSLRAEDTAIYYCARTGWLGPFDYWGQGTLVTVSS

SEQ ID NO: 743 - protein, 108 aa, Artificial Sequence; identical to SEQ ID NO: 23
  Description of Artificial Sequence: Synthetic polypeptide
  VL of XENP019810

SEQ ID NO: 744 - protein, 5 aa, Artificial Sequence
  Description of Artificial Sequence: Synthetic peptide
  XENP019810 vhCDR1
SYTMH

SEQ ID NO: 745 - protein, 17 aa, Artificial Sequence
  Description of Artificial Sequence: Synthetic peptide
  XENP019810 vhCDR2
FISYKGNNKYYADSVKG

SEQ ID NO: 746 - protein, 9 aa, Artificial Sequence
  Description of Artificial Sequence: Synthetic peptide
  XENP019810 vhCDR3
TGWLGPFDY

SEQ ID NO: 747 - protein, 12 aa, Artificial Sequence
  Description of Artificial Sequence: Synthetic peptide
  XENP019810 vlCDR1
RASQSVGSSYLA

SEQ ID NO: 748 - protein, 7 aa, Artificial Sequence
  Description of Artificial Sequence: Synthetic peptide
  XENP019810 vlCDR2
GAFSRAT

SEQ ID NO: 749 - protein, 9 aa, Artificial Sequence
  Description of Artificial Sequence: Synthetic peptide
  XENP019810 vlCDR3
QQYGSSPWT

SEQ ID NO: 750 - protein, 246 aa, Artificial Sequence
  Description of Artificial Sequence: Synthetic polypeptide
  XENP019811 [CTLA-4]_H0.63_L0_scFv(GKPGS)4
QVQLVESGGGVVQPGRSLRLSCAASGFTFSSYTMHWVRQAPGKGLEWVTFISYQGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 751 - protein, 118 aa, Artificial Sequence
  Description of Artificial Sequence: Synthetic polypeptide
  VH of XENP019811
QVQLVESGGGVVQPGRSLRLSCAASGFTFSSYTMHWVRQAPGKGLEWVTFISYQGNNKYYADSVKGRFTISRDNSKNTLYLQMNSLRAEDTAIYYCARTGWLGPFDYWGQGTLVTVSS

SEQ ID NO: 752 - protein, 108 aa, Artificial Sequence; identical to SEQ ID NO: 23
  Description of Artificial Sequence: Synthetic polypeptide
  VL of XENP019811

SEQ ID NO: 753 - protein, 5 aa, Artificial Sequence
  Description of Artificial Sequence: Synthetic peptide
  XENP019811 vhCDR1
SYTMH

SEQ ID NO: 754 - protein, 17 aa, Artificial Sequence
  Description of Artificial Sequence: Synthetic peptide
  XENP019811 vhCDR2
FISYQGNNKYYADSVKG

SEQ ID NO: 755 - protein, 9 aa, Artificial Sequence
  Description of Artificial Sequence: Synthetic peptide
  XENP019811 vhCDR3
TGWLGPFDY

SEQ ID NO: 756 - protein, 12 aa, Artificial Sequence
  Description of Artificial Sequence: Synthetic peptide
  XENP019811 vlCDR1
RASQSVGSSYLA

SEQ ID NO: 757 - protein, 7 aa, Artificial Sequence
  Description of Artificial Sequence: Synthetic peptide
  XENP019811 vlCDR2
GAFSRAT

SEQ ID NO: 758 - protein, 9 aa, Artificial Sequence
  Description of Artificial Sequence: Synthetic peptide
  XENP019811 vlCDR3
QQYGSSPWT

SEQ ID NO: 759 - protein, 246 aa, Artificial Sequence
  Description of Artificial Sequence: Synthetic polypeptide
  XENP019812 [CTLA-4]_H0.64_L0_scFv(GKPGS)4
QVQLVESGGGVVQPGRSLRLSCAASGFTFSSYTMHWVRQAPGKGLEWVTFISYDKNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 760 - protein, 118 aa, Artificial Sequence
  Description of Artificial Sequence: Synthetic polypeptide
  VH of XENP019812
QVQLVESGGGVVQPGRSLRLSCAASGFTFSSYTMHWVRQAPGKGLEWVTFISYDKNNKYYADSVKGRFTISRDNSKNTLYLQMNSLRAEDTAIYYCARTGWLGPFDYWGQGTLVTVSS

SEQ ID NO: 761 - protein, 108 aa, Artificial Sequence; identical to SEQ ID NO: 23
  Description of Artificial Sequence: Synthetic polypeptide
  VL of XENP019812

SEQ ID NO: 762 - protein, 5 aa, Artificial Sequence
  Description of Artificial Sequence: Synthetic peptide
  XENP019812 vhCDR1
SYTMH

SEQ ID NO: 763 - protein, 17 aa, Artificial Sequence
  Description of Artificial Sequence: Synthetic peptide
  XENP019812 vhCDR2
FISYDKNNKYYADSVKG

SEQ ID NO: 764 - protein, 9 aa, Artificial Sequence
  Description of Artificial Sequence: Synthetic peptide
  XENP019812 vhCDR3
TGWLGPFDY

SEQ ID NO: 765 - protein, 12 aa, Artificial Sequence
  Description of Artificial Sequence: Synthetic peptide
  XENP019812 vlCDR1
RASQSVGSSYLA

SEQ ID NO: 766 - protein, 7 aa, Artificial Sequence
  Description of Artificial Sequence: Synthetic peptide
  XENP019812 vlCDR2
GAFSRAT

SEQ ID NO: 767 - protein, 9 aa, Artificial Sequence
  Description of Artificial Sequence: Synthetic peptide
  XENP019812 vlCDR3
QQYGSSPWT

SEQ ID NO: 768 - protein, 246 aa, Artificial Sequence
  Description of Artificial Sequence: Synthetic polypeptide
  XENP019813 [CTLA-4]_H0.65_L0_scFv(GKPGS)4
QVQLVESGGGVVQPGRSLRLSCAASGFTFSSYTMHWVRQAPGKGLEWVTFISYDKNNKYYADSVKGRFTISEDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 769 - protein, 118 aa, Artificial Sequence
  Description of Artificial Sequence: Synthetic polypeptide
  VH of XENP019813
QVQLVESGGGVVQPGRSLRLSCAASGFTFSSYTMHWVRQAPGKGLEWVTFISYDKNNKYYADSVKGRFTISEDNSKNTLYLQMNSLRAEDTAIYYCARTGWLGPFDYWGQGTLVTVSS

SEQ ID NO: 770 - protein, 108 aa, Artificial Sequence; identical to SEQ ID NO: 23
  Description of Artificial Sequence: Synthetic polypeptide
  VL of XENP019813

SEQ ID NO: 771 - protein, 5 aa, Artificial Sequence
  Description of Artificial Sequence: Synthetic peptide
  XENP019813 vhCDR1
SYTMH

SEQ ID NO: 772 - protein, 17 aa, Artificial Sequence
  Description of Artificial Sequence: Synthetic peptide
  XENP019813 vhCDR2
FISYDKNNKYYADSVKG

SEQ ID NO: 773 - protein, 9 aa, Artificial Sequence
  Description of Artificial Sequence: Synthetic peptide
  XENP019813 vhCDR3
TGWLGPFDY

SEQ ID NO: 774 - protein, 12 aa, Artificial Sequence
  Description of Artificial Sequence: Synthetic peptide
  XENP019813 vlCDR1
RASQSVGSSYLA

SEQ ID NO: 775 - protein, 7 aa, Artificial Sequence
  Description of Artificial Sequence: Synthetic peptide
  XENP019813 vlCDR2
GAFSRAT

SEQ ID NO: 776 - protein, 9 aa, Artificial Sequence
  Description of Artificial Sequence: Synthetic peptide
  XENP019813 vlCDR3
QQYGSSPWT

SEQ ID NO: 777 - protein, 246 aa, Artificial Sequence
  Description of Artificial Sequence: Synthetic polypeptide
  XENP019814 [CTLA-4]_H0.66_L0_scFv(GKPGS)4
QVQLVESGGGVVQPGRSLRLSCAASGFTFSSYTMHWVRQAPGKGLEWVTFISYDGDNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 778 - protein, 118 aa, Artificial Sequence
  Description of Artificial Sequence: Synthetic polypeptide
  VH of XENP019814
QVQLVESGGGVVQPGRSLRLSCAASGFTFSSYTMHWVRQAPGKGLEWVTFISYDGDNKYYADSVKGRFTISRDNSKNTLYLQMNSLRAEDTAIYYCARTGWLGPFDYWGQGTLVTVSS

SEQ ID NO: 779 - protein, 108 aa, Artificial Sequence; identical to SEQ ID NO: 23
  Description of Artificial Sequence: Synthetic polypeptide
  VL of XENP019814

SEQ ID NO: 780 - protein, 5 aa, Artificial Sequence
  Description of Artificial Sequence: Synthetic peptide
  XENP019814 vhCDR1
SYTMH

SEQ ID NO: 781 - protein, 17 aa, Artificial Sequence
  Description of Artificial Sequence: Synthetic peptide
  XENP019814 vhCDR2
FISYDGDNKYYADSVKG

SEQ ID NO: 782 - protein, 9 aa, Artificial Sequence
  Description of Artificial Sequence: Synthetic peptide
  XENP019814 vhCDR3
TGWLGPFDY

SEQ ID NO: 783 - protein, 12 aa, Artificial Sequence
  Description of Artificial Sequence: Synthetic peptide
  XENP019814 vlCDR1
RASQSVGSSYLA

SEQ ID NO: 784 - protein, 7 aa, Artificial Sequence
  Description of Artificial Sequence: Synthetic peptide
  XENP019814 vlCDR2
GAFSRAT

SEQ ID NO: 785 - protein, 9 aa, Artificial Sequence
  Description of Artificial Sequence: Synthetic peptide
  XENP019814 vlCDR3
QQYGSSPWT

SEQ ID NO: 786 - protein, 246 aa, Artificial Sequence
  Description of Artificial Sequence: Synthetic polypeptide
  XENP019815 [CTLA-4]_H0.67_L0_scFv(GKPGS)4
QVQLVESGGGVVQPGRSLRLSCAASGFTFSSYTMHWVRQAPGKGLEWVTFISYDGGNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 787 - protein, 118 aa, Artificial Sequence
  Description of Artificial Sequence: Synthetic polypeptide
  VH of XENP019815
QVQLVESGGGVVQPGRSLRLSCAASGFTFSSYTMHWVRQAPGKGLEWVTFISYDGGNKYYADSVKGRFTISRDNSKNTLYLQMNSLRAEDTAIYYCARTGWLGPFDYWGQGTLVTVSS

SEQ ID NO: 788 - protein, 108 aa, Artificial Sequence; identical to SEQ ID NO: 23
  Description of Artificial Sequence: Synthetic polypeptide
  VL of XENP019815

SEQ ID NO: 789 - protein, 5 aa, Artificial Sequence
  Description of Artificial Sequence: Synthetic peptide
  XENP019815 vhCDR1
SYTMH

SEQ ID NO: 790 - protein, 17 aa, Artificial Sequence
  Description of Artificial Sequence: Synthetic peptide
  XENP019815 vhCDR2
FISYDGGNKYYADSVKG

SEQ ID NO: 791 - protein, 9 aa, Artificial Sequence
  Description of Artificial Sequence: Synthetic peptide
  XENP019815 vhCDR3
TGWLGPFDY

SEQ ID NO: 792 - protein, 12 aa, Artificial Sequence
  Description of Artificial Sequence: Synthetic peptide
  XENP019815 vlCDR1
RASQSVGSSYLA

SEQ ID NO: 793 - protein, 7 aa, Artificial Sequence
  Description of Artificial Sequence: Synthetic peptide
  XENP019815 vlCDR2
GAFSRAT

SEQ ID NO: 794 - protein, 9 aa, Artificial Sequence
  Description of Artificial Sequence: Synthetic peptide
  XENP019815 vlCDR3
QQYGSSPWT

SEQ ID NO: 795 - protein, 246 aa, Artificial Sequence
  Description of Artificial Sequence: Synthetic polypeptide
  XENP019816 [CTLA-4]_H0.68_L0_scFv(GKPGS)4
QVQLVESGGGVVQPGRSLRLSCAASGFTFSSYTMHWVRQAPGKGLEWVTFISYDGHNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 796 - protein, 118 aa, Artificial Sequence
  Description of Artificial Sequence: Synthetic polypeptide
  VH of XENP019816
QVQLVESGGGVVQPGRSLRLSCAASGFTFSSYTMHWVRQAPGKGLEWVTFISYDGHNKYYADSVKGRFTISRDNSKNTLYLQMNSLRAEDTAIYYCARTGWLGPFDYWGQGTLVTVSS

SEQ ID NO: 797 - protein, 108 aa, Artificial Sequence; identical to SEQ ID NO: 23
  Description of Artificial Sequence: Synthetic polypeptide
  VL of XENP019816

SEQ ID NO: 798 - protein, 5 aa, Artificial Sequence
  Description of Artificial Sequence: Synthetic peptide
  XENP019816 vhCDR1
SYTMH

SEQ ID NO: 799 - protein, 17 aa, Artificial Sequence
  Description of Artificial Sequence: Synthetic peptide
  XENP019816 vhCDR2
FISYDGHNKYYADSVKG

SEQ ID NO: 800 - protein, 9 aa, Artificial Sequence
  Description of Artificial Sequence: Synthetic peptide
  XENP019816 vhCDR3
TGWLGPFDY

SEQ ID NO: 801 - protein, 12 aa, Artificial Sequence
  Description of Artificial Sequence: Synthetic peptide
  XENP019816 vlCDR1
RASQSVGSSYLA

SEQ ID NO: 802 - protein, 7 aa, Artificial Sequence
  Description of Artificial Sequence: Synthetic peptide
  XENP019816 vlCDR2
GAFSRAT

SEQ ID NO: 803 - protein, 9 aa, Artificial Sequence
  Description of Artificial Sequence: Synthetic peptide
  XENP019816 vlCDR3
QQYGSSPWT

SEQ ID NO: 804 - protein, 246 aa, Artificial Sequence
  Description of Artificial Sequence: Synthetic polypeptide
  XENP019817 [CTLA-4]_H0.69_L0_scFv(GKPGS)4
QVQLVESGGGVVQPGRSLRLSCAASGFTFSSYTMHWVRQAPGKGLEWVTFISYDGQNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 805 - protein, 118 aa, Artificial Sequence
  Description of Artificial Sequence: Synthetic polypeptide
  VH of XENP019817
QVQLVESGGGVVQPGRSLRLSCAASGFTFSSYTMHWVRQAPGKGLEWVTFISYDGQNKYYADSVKGRFTISRDNSKNTLYLQMNSLRAEDTAIYYCARTGWLGPFDYWGQGTLVTVSS

SEQ ID NO: 806 - protein, 108 aa, Artificial Sequence; identical to SEQ ID NO: 23
  Description of Artificial Sequence: Synthetic polypeptide
  VL of XENP019817

SEQ ID NO: 807 - protein, 5 aa, Artificial Sequence
  Description of Artificial Sequence: Synthetic peptide
  XENP019817 vhCDR1
SYTMH

SEQ ID NO: 808 - protein, 17 aa, Artificial Sequence
  Description of Artificial Sequence: Synthetic peptide
  XENP019817 vhCDR2
FISYDGQNKYYADSVKG

SEQ ID NO: 809 - protein, 9 aa, Artificial Sequence
  Description of Artificial Sequence: Synthetic peptide
  XENP019817 vhCDR3
TGWLGPFDY

SEQ ID NO: 810 - protein, 12 aa, Artificial Sequence
  Description of Artificial Sequence: Synthetic peptide
  XENP019817 vlCDR1
RASQSVGSSYLA

SEQ ID NO: 811 - protein, 7 aa, Artificial Sequence
  Description of Artificial Sequence: Synthetic peptide
  XENP019817 vlCDR2
GAFSRAT

SEQ ID NO: 812 - protein, 9 aa, Artificial Sequence
  Description of Artificial Sequence: Synthetic peptide
  XENP019817 vlCDR3
QQYGSSPWT

SEQ ID NO: 813 - protein, 246 aa, Artificial Sequence
  Description of Artificial Sequence: Synthetic polypeptide
  XENP019818 [CTLA-4]_H0.70_L0_scFv(GKPGS)4
QVQLVESGGGVVQPGRSLRLSCAASGFTFSSYTMHWVRQAPGKGLEWVTFISYDGSNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 814 - protein, 118 aa, Artificial Sequence
  Description of Artificial Sequence: Synthetic polypeptide
  VH of XENP019818
QVQLVESGGGVVQPGRSLRLSCAASGFTFSSYTMHWVRQAPGKGLEWVTFISYDGSNKYYADSVKGRFTISRDNSKNTLYLQMNSLRAEDTAIYYCARTGWLGPFDYWGQGTLVTVSS

SEQ ID NO: 815 - protein, 108 aa, Artificial Sequence; identical to SEQ ID NO: 23
  Description of Artificial Sequence: Synthetic polypeptide
  VL of XENP019818

SEQ ID NO: 816 - protein, 5 aa, Artificial Sequence
  Description of Artificial Sequence: Synthetic peptide
  XENP019818 vhCDR1
SYTMH

SEQ ID NO: 817 - protein, 17 aa, Artificial Sequence
  Description of Artificial Sequence: Synthetic peptide
  XENP019818 vhCDR2
FISYDGSNKYYADSVKG

SEQ ID NO: 818 - protein, 9 aa, Artificial Sequence
  Description of Artificial Sequence: Synthetic peptide
  XENP019818 vhCDR3
TGWLGPFDY

SEQ ID NO: 819 - protein, 12 aa, Artificial Sequence
  Description of Artificial Sequence: Synthetic peptide
  XENP019818 vlCDR1
RASQSVGSSYLA

SEQ ID NO: 820 - protein, 7 aa, Artificial Sequence
  Description of Artificial Sequence: Synthetic peptide
  XENP019818 vlCDR2
GAFSRAT

SEQ ID NO: 821 - protein, 9 aa, Artificial Sequence
  Description of Artificial Sequence: Synthetic peptide
  XENP019818 vlCDR3
QQYGSSPWT

SEQ ID NO: 822 - protein, 246 aa, Artificial Sequence
  Description of Artificial Sequence: Synthetic polypeptide
  XENP019819 [CTLA-4]_H0.71_L0_scFv(GKPGS)4
QVQLVESGGGVVQPGRSLRLSCAASGFTFSSYTMHWVRQAPGKGLEWVTFISYDGNDKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 823 - protein, 118 aa, Artificial Sequence
  Description of Artificial Sequence: Synthetic polypeptide
  VH of XENP019819
QVQLVESGGGVVQPGRSLRLSCAASGFTFSSYTMHWVRQAPGKGLEWVTFISYDGNDKYYADSVKGRFTISRDNSKNTLYLQMNSLRAEDTAIYYCARTGWLGPFDYWGQGTLVTVSS

SEQ ID NO: 824 - protein, 108 aa, Artificial Sequence; identical to SEQ ID NO: 23
  Description of Artificial Sequence: Synthetic polypeptide
  VL of XENP019819

SEQ ID NO: 825 - protein, 5 aa, Artificial Sequence
  Description of Artificial Sequence: Synthetic peptide
  XENP019819 vhCDR1
SYTMH

SEQ ID NO: 826 - protein, 17 aa, Artificial Sequence
  Description of Artificial Sequence: Synthetic peptide
  XENP019819 vhCDR2
FISYDGNDKYYADSVKG

SEQ ID NO: 827 - protein, 9 aa, Artificial Sequence
  Description of Artificial Sequence: Synthetic peptide
  XENP019819 vhCDR3
TGWLGPFDY

SEQ ID NO: 828 - protein, 12 aa, Artificial Sequence
  Description of Artificial Sequence: Synthetic peptide
  XENP019819 vlCDR1
RASQSVGSSYLA

SEQ ID NO: 829 - protein, 7 aa, Artificial Sequence
  Description of Artificial Sequence: Synthetic peptide
  XENP019819 vlCDR2
GAFSRAT

SEQ ID NO: 830 - protein, 9 aa, Artificial Sequence
  Description of Artificial Sequence: Synthetic peptide
  XENP019819 vlCDR3
QQYGSSPWT

SEQ ID NO: 831 - protein, 246 aa, Artificial Sequence
  Description of Artificial Sequence: Synthetic polypeptide
  XENP019820 [CTLA-4]_H0.72_L0_scFv(GKPGS)4
QVQLVESGGGVVQPGRSLRLSCAASGFTFSSYTMHWVRQAPGKGLEWVTFISYDGNEKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 832 - protein, 118 aa, Artificial Sequence
  Description of Artificial Sequence: Synthetic polypeptide
  VH of XENP019820
QVQLVESGGGVVQPGRSLRLSCAASGFTFSSYTMHWVRQAPGKGLEWVTFISYDGNEKYYADSVKGRFTISRDNSKNTLYLQMNSLRAEDTAIYYCARTGWLGPFDYWGQGTLVTVSS

SEQ ID NO: 833 - protein, 108 aa, Artificial Sequence; identical to SEQ ID NO: 23
  Description of Artificial Sequence: Synthetic polypeptide
  VL of XENP019820

SEQ ID NO: 834 - protein, 5 aa, Artificial Sequence
  Description of Artificial Sequence: Synthetic peptide
  XENP019820 vhCDR1
SYTMH

SEQ ID NO: 835 - protein, 17 aa, Artificial Sequence
  Description of Artificial Sequence: Synthetic peptide
  XENP019820 vhCDR2
FISYDGNEKYYADSVKG

SEQ ID NO: 836 - protein, 9 aa, Artificial Sequence
  Description of Artificial Sequence: Synthetic peptide
  XENP019820 vhCDR3
TGWLGPFDY

SEQ ID NO: 837 - protein, 12 aa, Artificial Sequence
  Description of Artificial Sequence: Synthetic peptide
  XENP019820 vlCDR1
RASQSVGSSYLA

SEQ ID NO: 838 - protein, 7 aa, Artificial Sequence
  Description of Artificial Sequence: Synthetic peptide
  XENP019820 vlCDR2
GAFSRAT

SEQ ID NO: 839 - protein, 9 aa, Artificial Sequence
  Description of Artificial Sequence: Synthetic peptide
  XENP019820 vlCDR3
QQYGSSPWT

SEQ ID NO: 840 - protein, 246 aa, Artificial Sequence
  Description of Artificial Sequence: Synthetic polypeptide
  XENP019821 [CTLA-4]_H0.73_L0_scFv(GKPGS)4
QVQLVESGGGVVQPGRSLRLSCAASGFTFSSYTMHWVRQAPGKGLEWVTFISYDGNHKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 841 - protein, 118 aa, Artificial Sequence
  Description of Artificial Sequence: Synthetic polypeptide
  VH of XENP019821
QVQLVESGGGVVQPGRSLRLSCAASGFTFSSYTMHWVRQAPGKGLEWVTFISYDGNHKYYADSVKGRFTISRDNSKNTLYLQMNSLRAEDTAIYYCARTGWLGPFDYWGQGTLVTVSS

SEQ ID NO: 842 - protein, 108 aa, Artificial Sequence; identical to SEQ ID NO: 23
  Description of Artificial Sequence: Synthetic polypeptide
  VL of XENP019821

SEQ ID NO: 843 - protein, 5 aa, Artificial Sequence
  Description of Artificial Sequence: Synthetic peptide
  XENP019821 vhCDR1
SYTMH

SEQ ID NO: 844 - protein, 17 aa, Artificial Sequence
  Description of Artificial Sequence: Synthetic peptide
  XENP019821 vhCDR2
FISYDGNHKYYADSVKG

SEQ ID NO: 845 - protein, 9 aa, Artificial Sequence
  Description of Artificial Sequence: Synthetic peptide
  XENP019821 vhCDR3
TGWLGPFDY

SEQ ID NO: 846 - protein, 12 aa, Artificial Sequence
  Description of Artificial Sequence: Synthetic peptide
  XENP019821 vlCDR1
RASQSVGSSYLA

SEQ ID NO: 847 - protein, 7 aa, Artificial Sequence
  Description of Artificial Sequence: Synthetic peptide
  XENP019821 vlCDR2
GAFSRAT

SEQ ID NO: 848 - protein, 9 aa, Artificial Sequence
  Description of Artificial Sequence: Synthetic peptide
  XENP019821 vlCDR3
QQYGSSPWT

SEQ ID NO: 849 - protein, 246 aa, Artificial Sequence
  Description of Artificial Sequence: Synthetic polypeptide
  XENP019822 [CTLA-4]_H0.74_L0_scFv(GKPGS)4
QVQLVESGGGVVQPGRSLRLSCAASGFTFSSYTMHWVRQAPGKGLEWVTFISYDGNSKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 850 - protein, 118 aa, Artificial Sequence
  Description of Artificial Sequence: Synthetic polypeptide
  VH of XENP019822
QVQLVESGGGVVQPGRSLRLSCAASGFTFSSYTMHWVRQAPGKGLEWVTFISYDGNSKYYADSVKGRFTISRDNSKNTLYLQMNSLRAEDTAIYYCARTGWLGPFDYWGQGTLVTVSS

SEQ ID NO: 851 - protein, 108 aa, Artificial Sequence; identical to SEQ ID NO: 23
  Description of Artificial Sequence: Synthetic polypeptide
  VL of XENP019822

SEQ ID NO: 852 - protein, 5 aa, Artificial Sequence
  Description of Artificial Sequence: Synthetic peptide
  XENP019822 vhCDR1
SYTMH

SEQ ID NO: 853 - protein, 17 aa, Artificial Sequence
  Description of Artificial Sequence: Synthetic peptide
  XENP019822 vhCDR2
FISYDGNSKYYADSVKG

SEQ ID NO: 854 - protein, 9 aa, Artificial Sequence
  Description of Artificial Sequence: Synthetic peptide
  XENP019822 vhCDR3
TGWLGPFDY

SEQ ID NO: 855 - protein, 12 aa, Artificial Sequence
  Description of Artificial Sequence: Synthetic peptide
  XENP019822 vlCDR1
RASQSVGSSYLA

SEQ ID NO: 856 - protein, 7 aa, Artificial Sequence
  Description of Artificial Sequence: Synthetic peptide
  XENP019822 vlCDR2
GAFSRAT

SEQ ID NO: 857 - protein, 9 aa, Artificial Sequence
  Description of Artificial Sequence: Synthetic peptide
  XENP019822 vlCDR3
QQYGSSPWT

SEQ ID NO: 858 - protein, 246 aa, Artificial Sequence
  Description of Artificial Sequence: Synthetic polypeptide
  XENP019823 [CTLA-4]_H0.75_L0_scFv(GKPGS)4
QVQLVESGGGVVQPGRSLRLSCAASGFTFSSYTMHWVRQAPGKGLEWVTFISYDGNTKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 859 - protein, 118 aa, Artificial Sequence
  Description of Artificial Sequence: Synthetic polypeptide
  VH of XENP019823
QVQLVESGGGVVQPGRSLRLSCAASGFTFSSYTMHWVRQAPGKGLEWVTFISYDGNTKYYADSVKGRFTISRDNSKNTLYLQMNSLRAEDTAIYYCARTGWLGPFDYWGQGTLVTVSS

SEQ ID NO: 860 - protein, 108 aa, Artificial Sequence; identical to SEQ ID NO: 23
  Description of Artificial Sequence: Synthetic polypeptide
  VL of XENP019823

SEQ ID NO: 861 - protein, 5 aa, Artificial Sequence
  Description of Artificial Sequence: Synthetic peptide
  XENP019823 vhCDR1
SYTMH

SEQ ID NO: 862 - protein, 17 aa, Artificial Sequence
  Description of Artificial Sequence: Synthetic peptide
  XENP019823 vhCDR2
FISYDGNTKYYADSVKG

SEQ ID NO: 863 - protein, 9 aa, Artificial Sequence
  Description of Artificial Sequence: Synthetic peptide
  XENP019823 vhCDR3
TGWLGPFDY

SEQ ID NO: 864 - protein, 12 aa, Artificial Sequence
  Description of Artificial Sequence: Synthetic peptide
  XENP019823 vlCDR1
RASQSVGSSYLA

SEQ ID NO: 865 - protein, 7 aa, Artificial Sequence
  Description of Artificial Sequence: Synthetic peptide
  XENP019823 vlCDR2
GAFSRAT

SEQ ID NO: 866 - protein, 9 aa, Artificial Sequence
  Description of Artificial Sequence: Synthetic peptide
  XENP019823 vlCDR3
QQYGSSPWT

SEQ ID NO: 867 - protein, 246 aa, Artificial Sequence
  Description of Artificial Sequence: Synthetic polypeptide
  XENP019824 [CTLA-4]_H0.76_L0_scFv(GKPGS)4
QVQLVESGGGVVQPGRSLRLSCAASGFTFSSYTMHWVRQAPGKGLEWVTFISYDGNQKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 868 - protein, 118 aa, Artificial Sequence
  Description of Artificial Sequence: Synthetic polypeptide
  VH of XENP019824
QVQLVESGGGVVQPGRSLRLSCAASGFTFSSYTMHWVRQAPGKGLEWVTFISYDGNQKYYADSVKGRFTISRDNSKNTLYLQMNSLRAEDTAIYYCARTGWLGPFDYWGQGTLVTVSS

SEQ ID NO: 869 - protein, 108 aa, Artificial Sequence; identical to SEQ ID NO: 23
  Description of Artificial Sequence: Synthetic polypeptide
  VL of XENP019824

SEQ ID NO: 870 - protein, 5 aa, Artificial Sequence
  Description of Artificial Sequence: Synthetic peptide
  XENP019824 vhCDR1
SYTMH

SEQ ID NO: 871 - protein, 17 aa, Artificial Sequence
  Description of Artificial Sequence: Synthetic peptide
  XENP019824 vhCDR2
FISYDGNQKYYADSVKG

SEQ ID NO: 872 - protein, 9 aa, Artificial Sequence
  Description of Artificial Sequence: Synthetic peptide
  XENP019824 vhCDR3
TGWLGPFDY

SEQ ID NO: 873 - protein, 12 aa, Artificial Sequence
  Description of Artificial Sequence: Synthetic peptide
  XENP019824 vlCDR1
RASQSVGSSYLA

SEQ ID NO: 874 - protein, 7 aa, Artificial Sequence
  Description of Artificial Sequence: Synthetic peptide
  XENP019824 vlCDR2
GAFSRAT

SEQ ID NO: 875 - protein, 9 aa, Artificial Sequence
  Description of Artificial Sequence: Synthetic peptide
  XENP019824 vlCDR3
QQYGSSPWT

SEQ ID NO: 876 - protein, 246 aa, Artificial Sequence
  Description of Artificial Sequence: Synthetic polypeptide
  XENP019825 [CTLA-4]_H0.77_L0_scFv(GKPGS)4
QVQLVESGGGVVQPGRSLRLSCAASGFTFSSYTMHWVRQAPGKGLEWVTFISYDGNNIYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 877 - protein, 118 aa, Artificial Sequence
  Description of Artificial Sequence: Synthetic polypeptide
  VH of XENP019825
QVQLVESGGGVVQPGRSLRLSCAASGFTFSSYTMHWVRQAPGKGLEWVTFISYDGNNIYYADSVKGRFTISRDNSKNTLYLQMNSLRAEDTAIYYCARTGWLGPFDYWGQGTLVTVSS

SEQ ID NO: 878 - protein, 108 aa, Artificial Sequence; identical to SEQ ID NO: 23
  Description of Artificial Sequence: Synthetic polypeptide
  VL of XENP019825

SEQ ID NO: 879 - protein, 5 aa, Artificial Sequence
  Description of Artificial Sequence: Synthetic peptide
  XENP019825 vhCDR1
SYTMH

SEQ ID NO: 880 - protein, 17 aa, Artificial Sequence
  Description of Artificial Sequence: Synthetic peptide
  XENP019825 vhCDR2
FISYDGNNIYYADSVKG

SEQ ID NO: 881 - protein, 9 aa, Artificial Sequence
  Description of Artificial Sequence: Synthetic peptide
  XENP019825 vhCDR3
TGWLGPFDY

SEQ ID NO: 882 - protein, 12 aa, Artificial Sequence
  Description of Artificial Sequence: Synthetic peptide
  XENP019825 vlCDR1
RASQSVGSSYLA

SEQ ID NO: 883 - protein, 7 aa, Artificial Sequence
  Description of Artificial Sequence: Synthetic peptide
  XENP019825 vlCDR2
GAFSRAT

SEQ ID NO: 884 - protein, 9 aa, Artificial Sequence
  Description of Artificial Sequence: Synthetic peptide
  XENP019825 vlCDR3
QQYGSSPWT

SEQ ID NO: 885 - protein, 246 aa, Artificial Sequence
  Description of Artificial Sequence: Synthetic polypeptide
  XENP019826 [CTLA-4]_H0.78_L0_scFv(GKPGS)4
QVQLVESGGGVVQPGRSLRLSCAASGFTFSSYTMHWVRQAPGKGLEWVTFISYDGNNTYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 886 - protein, 118 aa, Artificial Sequence
  Description of Artificial Sequence: Synthetic polypeptide
  VH of XENP019826
QVQLVESGGGVVQPGRSLRLSCAASGFTFSSYTMHWVRQAPGKGLEWVTFISYDGNNTYYADSVKGRFTISRDNSKNTLYLQMNSLRAEDTAIYYCARTGWLGPFDYWGQGTLVTVSS

SEQ ID NO: 887 - protein, 108 aa, Artificial Sequence; identical to SEQ ID NO: 23
  Description of Artificial Sequence: Synthetic polypeptide
  VL of XENP019826

SEQ ID NO: 888 - protein, 5 aa, Artificial Sequence
  Description of Artificial Sequence: Synthetic peptide
  XENP019826 vhCDR1
SYTMH

SEQ ID NO: 889 - protein, 17 aa, Artificial Sequence
  Description of Artificial Sequence: Synthetic peptide
  XENP019826 vhCDR2
FISYDGNNTYYADSVKG

SEQ ID NO: 890 - protein, 9 aa, Artificial Sequence
  Description of Artificial Sequence: Synthetic peptide
  XENP019826 vhCDR3
TGWLGPFDY

SEQ ID NO: 891 - protein, 12 aa, Artificial Sequence
  Description of Artificial Sequence: Synthetic peptide
  XENP019826 vlCDR1
RASQSVGSSYLA

SEQ ID NO: 892 - protein, 7 aa, Artificial Sequence
  Description of Artificial Sequence: Synthetic peptide
  XENP019826 vlCDR2
GAFSRAT

SEQ ID NO: 893 - protein, 9 aa, Artificial Sequence
  Description of Artificial Sequence: Synthetic peptide
  XENP019826 vlCDR3
QQYGSSPWT

SEQ ID NO: 894 - protein, 246 aa, Artificial Sequence
  Description of Artificial Sequence: Synthetic polypeptide
  XENP019827 [CTLA-4]_H0.79_L0_scFv(GKPGS)4
QVQLVESGGGVVQPGRSLRLSCAASGFTFSSYTMHWVRQAPGKGLEWVTFISYDGNNKAYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 895 - protein, 118 aa, Artificial Sequence
  Description of Artificial Sequence: Synthetic polypeptide
  VH of XENP019827
QVQLVESGGGVVQPGRSLRLSCAASGFTFSSYTMHWVRQAPGKGLEWVTFISYDGNNKAYADSVKGRFTISRDNSKNTLYLQMNSLRAEDTAIYYCARTGWLGPFDYWGQGTLVTVSS

SEQ ID NO: 896 - protein, 108 aa, Artificial Sequence; identical to SEQ ID NO: 23
  Description of Artificial Sequence: Synthetic polypeptide
  VL of XENP019827

SEQ ID NO: 897 - protein, 5 aa, Artificial Sequence
  Description of Artificial Sequence: Synthetic peptide
  XENP019827 vhCDR1
SYTMH

SEQ ID NO: 898 - protein, 17 aa, Artificial Sequence
  Description of Artificial Sequence: Synthetic peptide
  XENP019827 vhCDR2
FISYDGNNKAYADSVKG

SEQ ID NO: 899 - protein, 9 aa, Artificial Sequence
  Description of Artificial Sequence: Synthetic peptide
  XENP019827 vhCDR3
TGWLGPFDY

SEQ ID NO: 900 - protein, 12 aa, Artificial Sequence
  Description of Artificial Sequence: Synthetic peptide
  XENP019827 vlCDR1
RASQSVGSSYLA

SEQ ID NO: 901 - protein, 7 aa, Artificial Sequence
  Description of Artificial Sequence: Synthetic peptide
  XENP019827 vlCDR2
GAFSRAT

SEQ ID NO: 902 - protein, 9 aa, Artificial Sequence
  Description of Artificial Sequence: Synthetic peptide
  XENP019827 vlCDR3
QQYGSSPWT

SEQ ID NO: 903 - protein, 246 aa, Artificial Sequence
  Description of Artificial Sequence: Synthetic polypeptide
  XENP019828 [CTLA-4]_H0.80_L0_scFv(GKPGS)4
QVQLVESGGGVVQPGRSLRLSCAASGFTFSSYTMHWVRQAPGKGLEWVTFISYDGNNKYYAASVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 904 - protein, 118 aa, Artificial Sequence
  Description of Artificial Sequence: Synthetic polypeptide
  VH of XENP019828
QVQLVESGGGVVQPGRSLRLSCAASGFTFSSYTMHWVRQAPGKGLEWVTFISYDGNNKYYAASVKGRFTISRDNSKNTLYLQMNSLRAEDTAIYYCARTGWLGPFDYWGQGTLVTVSS

SEQ ID NO: 905 - protein, 108 aa, Artificial Sequence; identical to SEQ ID NO: 23
  Description of Artificial Sequence: Synthetic polypeptide
  VL of XENP019828

SEQ ID NO: 906 - protein, 5 aa, Artificial Sequence
  Description of Artificial Sequence: Synthetic peptide
  XENP019828 vhCDR1
SYTMH

SEQ ID NO: 907 - protein, 17 aa, Artificial Sequence
  Description of Artificial Sequence: Synthetic peptide
  XENP019828 vhCDR2
FISYDGNNKYYAASVKG

SEQ ID NO: 908 - protein, 9 aa, Artificial Sequence
  Description of Artificial Sequence: Synthetic peptide
  XENP019828 vhCDR3
TGWLGPFDY

SEQ ID NO: 909 - protein, 12 aa, Artificial Sequence
  Description of Artificial Sequence: Synthetic peptide
  XENP019828 vlCDR1
RASQSVGSSYLA

SEQ ID NO: 910 - protein, 7 aa, Artificial Sequence
  Description of Artificial Sequence: Synthetic peptide
  XENP019828 vlCDR2
GAFSRAT

SEQ ID NO: 911 - protein, 9 aa, Artificial Sequence
  Description of Artificial Sequence: Synthetic peptide
  XENP019828 vlCDR3
QQYGSSPWT

SEQ ID NO: 912 - protein, 246 aa, Artificial Sequence
  Description of Artificial Sequence: Synthetic polypeptide
  XENP019829 [CTLA-4]_H0.81_L0_scFv(GKPGS)4
QVQLVESGGGVVQPGRSLRLSCAASGFTFSSYTMHWVRQAPGKGLEWVTFISYDGNNKYYAKSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 913 - protein, 118 aa, Artificial Sequence
  Description of Artificial Sequence: Synthetic polypeptide
  VH of XENP019829
QVQLVESGGGVVQPGRSLRLSCAASGFTFSSYTMHWVRQAPGKGLEWVTFISYDGNNKYYAKSVKGRFTISRDNSKNTLYLQMNSLRAEDTAIYYCARTGWLGPFDYWGQGTLVTVSS

SEQ ID NO: 914 - protein, 108 aa, Artificial Sequence; identical to SEQ ID NO: 23
  Description of Artificial Sequence: Synthetic polypeptide
  VL of XENP019829

SEQ ID NO: 915 - protein, 5 aa, Artificial Sequence
  Description of Artificial Sequence: Synthetic peptide
  XENP019829 vhCDR1
SYTMH

SEQ ID NO: 916 - protein, 17 aa, Artificial Sequence
  Description of Artificial Sequence: Synthetic peptide
  XENP019829 vhCDR2
FISYDGNNKYYAKSVKG

SEQ ID NO: 917 - protein, 9 aa, Artificial Sequence
  Description of Artificial Sequence: Synthetic peptide
  XENP019829 vhCDR3
TGWLGPFDY

SEQ ID NO: 918 - protein, 12 aa, Artificial Sequence
  Description of Artificial Sequence: Synthetic peptide
  XENP019829 vlCDR1
RASQSVGSSYLA

SEQ ID NO: 919 - protein, 7 aa, Artificial Sequence
  Description of Artificial Sequence: Synthetic peptide
  XENP019829 vlCDR2
GAFSRAT

SEQ ID NO: 920 - protein, 9 aa, Artificial Sequence
  Description of Artificial Sequence: Synthetic peptide
  XENP019829 vlCDR3
QQYGSSPWT

SEQ ID NO: 921 - protein, 246 aa, Artificial Sequence
  Description of Artificial Sequence: Synthetic polypeptide
  XENP019830 [CTLA-4]_H0.82_L0_scFv(GKPGS)4
QVQLVESGGGVVQPGRSLRLSCAASGFTFSSYTMHWVRQAPGKGLEWVTFISYDGNNKYYADSVKDRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 922 - protein, 118 aa, Artificial Sequence
  Description of Artificial Sequence: Synthetic polypeptide
  VH of XENP019830
QVQLVESGGGVVQPGRSLRLSCAASGFTFSSYTMHWVRQAPGKGLEWVTFISYDGNNKYYADSVKDRFTISRDNSKNTLYLQMNSLRAEDTAIYYCARTGWLGPFDYWGQGTLVTVSS

SEQ ID NO: 923 - protein, 108 aa, Artificial Sequence; identical to SEQ ID NO: 23
  Description of Artificial Sequence: Synthetic polypeptide
  VL of XENP019830

SEQ ID NO: 924 - protein, 5 aa, Artificial Sequence
  Description of Artificial Sequence: Synthetic peptide
  XENP019830 vhCDR1
SYTMH

SEQ ID NO: 925 - protein, 17 aa, Artificial Sequence
  Description of Artificial Sequence: Synthetic peptide
  XENP019830 vhCDR2
FISYDGNNKYYADSVKD

SEQ ID NO: 926 - protein, 9 aa, Artificial Sequence
  Description of Artificial Sequence: Synthetic peptide
  XENP019830 vhCDR3
TGWLGPFDY

SEQ ID NO: 927 - protein, 12 aa, Artificial Sequence
  Description of Artificial Sequence: Synthetic peptide
  XENP019830 vlCDR1
RASQSVGSSYLA

SEQ ID NO: 928 - protein, 7 aa, Artificial Sequence
  Description of Artificial Sequence: Synthetic peptide
  XENP019830 vlCDR2
GAFSRAT

SEQ ID NO: 929 - protein, 9 aa, Artificial Sequence
  Description of Artificial Sequence: Synthetic peptide
  XENP019830 vlCDR3
QQYGSSPWT

SEQ ID NO: 930 - protein, 246 aa, Artificial Sequence
  Description of Artificial Sequence: Synthetic polypeptide
  XENP019831 [CTLA-4]_H0.83_L0_scFv(GKPGS)4
QVQLVESGGGVVQPGRSLRLSCAASGFTFSSYTMHWVRQAPGKGLEWVTFISYDGNNKYYADSVKERFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 931 - protein, 118 aa, Artificial Sequence
  Description of Artificial Sequence: Synthetic polypeptide
  VH of XENP019831
QVQLVESGGGVVQPGRSLRLSCAASGFTFSSYTMHWVRQAPGKGLEWVTFISYDGNNKYYADSVKERFTISRDNSKNTLYLQMNSLRAEDTAIYYCARTGWLGPFDYWGQGTLVTVSS

SEQ ID NO: 932 - protein, 108 aa, Artificial Sequence; identical to SEQ ID NO: 23
  Description of Artificial Sequence: Synthetic polypeptide
  VL of XENP019831

SEQ ID NO: 933 - protein, 5 aa, Artificial Sequence
  Description of Artificial Sequence: Synthetic peptide
  XENP019831 vhCDR1
SYTMH

SEQ ID NO: 934 - protein, 17 aa, Artificial Sequence
  Description of Artificial Sequence: Synthetic peptide
  XENP019831 vhCDR2
FISYDGNNKYYADSVKE

SEQ ID NO: 935 - protein, 9 aa, Artificial Sequence
  Description of Artificial Sequence: Synthetic peptide
  XENP019831 vhCDR3
TGWLGPFDY

SEQ ID NO: 936 - protein, 12 aa, Artificial Sequence
  Description of Artificial Sequence: Synthetic peptide
  XENP019831 vlCDR1
RASQSVGSSYLA

SEQ ID NO: 937 - protein, 7 aa, Artificial Sequence
  Description of Artificial Sequence: Synthetic peptide
  XENP019831 vlCDR2
GAFSRAT

SEQ ID NO: 938 - protein, 9 aa, Artificial Sequence
  Description of Artificial Sequence: Synthetic peptide
  XENP019831 vlCDR3
QQYGSSPWT

SEQ ID NO: 939 - protein, 246 aa, Artificial Sequence
  Description of Artificial Sequence: Synthetic polypeptide
  XENP019832 [CTLA-4]_H0.84_L0_scFv(GKPGS)4
QVQLVESGGGVVQPGRSLRLSCAASGFTFSSYTMHWVRQAPGKGLEWVTFISYDGNNKYYADSVKGQFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 940 - protein, 118 aa, Artificial Sequence
  Description of Artificial Sequence: Synthetic polypeptide
  VH of XENP019832
QVQLVESGGGVVQPGRSLRLSCAASGFTFSSYTMHWVRQAPGKGLEWVTFISYDGNNKYYADSVKGQFTISRDNSKNTLYLQMNSLRAEDTAIYYCARTGWLGPFDYWGQGTLVTVSS

SEQ ID NO: 941 - protein, 108 aa, Artificial Sequence; identical to SEQ ID NO: 23
  Description of Artificial Sequence: Synthetic polypeptide
  VL of XENP019832

SEQ ID NO: 942 - protein, 5 aa, Artificial Sequence
  Description of Artificial Sequence: Synthetic peptide
  XENP019832 vhCDR1
SYTMH

SEQ ID NO: 943 - protein, 17 aa, Artificial Sequence
  Description of Artificial Sequence: Synthetic peptide
  XENP019832 vhCDR2
FISYDGNNKYYADSVKG

SEQ ID NO: 944 - protein, 9 aa, Artificial Sequence
  Description of Artificial Sequence: Synthetic peptide
  XENP019832 vhCDR3
TGWLGPFDY

SEQ ID NO: 945 - protein, 12 aa, Artificial Sequence
  Description of Artificial Sequence: Synthetic peptide
  XENP019832 vlCDR1
RASQSVGSSYLA

SEQ ID NO: 946 - protein, 7 aa, Artificial Sequence
  Description of Artificial Sequence: Synthetic peptide
  XENP019832 vlCDR2
GAFSRAT

SEQ ID NO: 947 - protein, 9 aa, Artificial Sequence
  Description of Artificial Sequence: Synthetic peptide
  XENP019832 vlCDR3
QQYGSSPWT

SEQ ID NO: 948 - protein, 246 aa, Artificial Sequence
  Description of Artificial Sequence: Synthetic polypeptide
  XENP019833 [CTLA-4]_H0.85_L0_scFv(GKPGS)4
QVQLVESGGGVVQPGRSLRLSCAASGFTFSSYTMHWVRQAPGKGLEWVTFISYDGNNKYYADSVKGRFTMSRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 949 - protein, 118 aa, Artificial Sequence
  Description of Artificial Sequence: Synthetic polypeptide
  VH of XENP019833
QVQLVESGGGVVQPGRSLRLSCAASGFTFSSYTMHWVRQAPGKGLEWVTFISYDGNNKYYADSVKGRFTMSRDNSKNTLYLQMNSLRAEDTAIYYCARTGWLGPFDYWGQGTLVTVSS

SEQ ID NO: 950 - protein, 108 aa, Artificial Sequence; identical to SEQ ID NO: 23
  Description of Artificial Sequence: Synthetic polypeptide
  VL of XENP019833

SEQ ID NO: 951 - protein, 5 aa, Artificial Sequence
  Description of Artificial Sequence: Synthetic peptide
  XENP019833 vhCDR1
SYTMH

SEQ ID NO: 952 - protein, 17 aa, Artificial Sequence
  Description of Artificial Sequence: Synthetic peptide
  XENP019833 vhCDR2
FISYDGNNKYYADSVKG

SEQ ID NO: 953 - protein, 9 aa, Artificial Sequence
  Description of Artificial Sequence: Synthetic peptide
  XENP019833 vhCDR3
TGWLGPFDY

SEQ ID NO: 954 - protein, 12 aa, Artificial Sequence
  Description of Artificial Sequence: Synthetic peptide
  XENP019833 vlCDR1
RASQSVGSSYLA

SEQ ID NO: 955 - protein, 7 aa, Artificial Sequence
  Description of Artificial Sequence: Synthetic peptide
  XENP019833 vlCDR2
GAFSRAT

SEQ ID NO: 956 - protein, 9 aa, Artificial Sequence
  Description of Artificial Sequence: Synthetic peptide
  XENP019833 vlCDR3
QQYGSSPWT

SEQ ID NO: 957 - protein, 246 aa, Artificial Sequence
  Description of Artificial Sequence: Synthetic polypeptide
  XENP019834 [CTLA-4]_H0.86_L0_scFv(GKPGS)4
QVQLVESGGGVVQPGRSLRLSCAASGFTFSSYTMHWVRQAPGKGLEWVTFISYDGNNKYYADSVKGRFTVSRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 958 - protein, 118 aa, Artificial Sequence
  Description of Artificial Sequence: Synthetic polypeptide
  VH of XENP019834
QVQLVESGGGVVQPGRSLRLSCAASGFTFSSYTMHWVRQAPGKGLEWVTFISYDGNNKYYADSVKGRFTVSRDNSKNTLYLQMNSLRAEDTAIYYCARTGWLGPFDYWGQGTLVTVSS

SEQ ID NO: 959 - protein, 108 aa, Artificial Sequence; identical to SEQ ID NO: 23
  Description of Artificial Sequence: Synthetic polypeptide
  VL of XENP019834

SEQ ID NO: 960 - protein, 5 aa, Artificial Sequence
  Description of Artificial Sequence: Synthetic peptide
  XENP019834 vhCDR1
SYTMH

SEQ ID NO: 961 - protein, 17 aa, Artificial Sequence
  Description of Artificial Sequence: Synthetic peptide
  XENP019834 vhCDR2
FISYDGNNKYYADSVKG

SEQ ID NO: 962 - protein, 9 aa, Artificial Sequence
  Description of Artificial Sequence: Synthetic peptide
  XENP019834 vhCDR3
TGWLGPFDY

SEQ ID NO: 963 - protein, 12 aa, Artificial Sequence
  Description of Artificial Sequence: Synthetic peptide
  XENP019834 vlCDR1
RASQSVGSSYLA

SEQ ID NO: 964 - protein, 7 aa, Artificial Sequence
  Description of Artificial Sequence: Synthetic peptide
  XENP019834 vlCDR2
GAFSRAT

SEQ ID NO: 965 - protein, 9 aa, Artificial Sequence
  Description of Artificial Sequence: Synthetic peptide
  XENP019834 vlCDR3
QQYGSSPWT

SEQ ID NO: 966 - protein, 246 aa, Artificial Sequence
  Description of Artificial Sequence: Synthetic polypeptide
  XENP019835 [CTLA-4]_H0.87_L0_scFv(GKPGS)4
QVQLVESGGGVVQPGRSLRLSCAASGFTFSSYTMHWVRQAPGKGLEWVTFISYDGNNKYYADSVKGRFTISEDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 967 - protein, 118 aa, Artificial Sequence
  Description of Artificial Sequence: Synthetic polypeptide
  VH of XENP019835
QVQLVESGGGVVQPGRSLRLSCAASGFTFSSYTMHWVRQAPGKGLEWVTFISYDGNNKYYADSVKGRFTISEDNSKNTLYLQMNSLRAEDTAIYYCARTGWLGPFDYWGQGTLVTVSS

SEQ ID NO: 968 - protein, 108 aa, Artificial Sequence; identical to SEQ ID NO: 23
  Description of Artificial Sequence: Synthetic polypeptide
  VL of XENP019835

SEQ ID NO: 969 - protein, 5 aa, Artificial Sequence
  Description of Artificial Sequence: Synthetic peptide
  XENP019835 vhCDR1
SYTMH

SEQ ID NO: 970 - protein, 17 aa, Artificial Sequence
  Description of Artificial Sequence: Synthetic peptide
  XENP019835 vhCDR2
FISYDGNNKYYADSVKG

SEQ ID NO: 971 - protein, 9 aa, Artificial Sequence
  Description of Artificial Sequence: Synthetic peptide
  XENP019835 vhCDR3
TGWLGPFDY

SEQ ID NO: 972 - protein, 12 aa, Artificial Sequence
  Description of Artificial Sequence: Synthetic peptide
  XENP019835 vlCDR1
RASQSVGSSYLA

SEQ ID NO: 973 - protein, 7 aa, Artificial Sequence
  Description of Artificial Sequence: Synthetic peptide
  XENP019835 vlCDR2
GAFSRAT

SEQ ID NO: 974 - protein, 9 aa, Artificial Sequence
  Description of Artificial Sequence: Synthetic peptide
  XENP019835 vlCDR3
QQYGSSPWT

SEQ ID NO: 975 - protein, 246 aa, Artificial Sequence
  Description of Artificial Sequence: Synthetic polypeptide
  XENP019836 [CTLA-4]_H0.88_L0_scFv(GKPGS)4
QVQLVESGGGVVQPGRSLRLSCAASGFTFSSYTMHWVRQAPGKGLEWVTFISYDGNNKYYADSVKGRFTISRENSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 976 - protein, 118 aa, Artificial Sequence
  Description of Artificial Sequence: Synthetic polypeptide
  VH of XENP019836
QVQLVESGGGVVQPGRSLRLSCAASGFTFSSYTMHWVRQAPGKGLEWVTFISYDGNNKYYADSVKGRFTISRENSKNTLYLQMNSLRAEDTAIYYCARTGWLGPFDYWGQGTLVTVSS

SEQ ID NO: 977 - protein, 108 aa, Artificial Sequence; identical to SEQ ID NO: 23
  Description of Artificial Sequence: Synthetic polypeptide
  VL of XENP019836

SEQ ID NO: 978 - protein, 5 aa, Artificial Sequence
  Description of Artificial Sequence: Synthetic peptide
  XENP019836 vhCDR1
SYTMH

SEQ ID NO: 979 - protein, 17 aa, Artificial Sequence
  Description of Artificial Sequence: Synthetic peptide
  XENP019836 vhCDR2
FISYDGNNKYYADSVKG

SEQ ID NO: 980 - protein, 9 aa, Artificial Sequence
  Description of Artificial Sequence: Synthetic peptide
  XENP019836 vhCDR3
TGWLGPFDY

SEQ ID NO: 981 - protein, 12 aa, Artificial Sequence
  Description of Artificial Sequence: Synthetic peptide
  XENP019836 vlCDR1
RASQSVGSSYLA

SEQ ID NO: 982 - protein, 7 aa, Artificial Sequence
  Description of Artificial Sequence: Synthetic peptide
  XENP019836 vlCDR2
GAFSRAT

SEQ ID NO: 983 - protein, 9 aa, Artificial Sequence
  Description of Artificial Sequence: Synthetic peptide
  XENP019836 vlCDR3
QQYGSSPWT

SEQ ID NO: 984 - protein, 246 aa, Artificial Sequence
  Description of Artificial Sequence: Synthetic polypeptide
  XENP019837 [CTLA-4]_H0.89_L0_scFv(GKPGS)4
QVQLVESGGGVVQPGRSLRLSCAASGFTFSSYTMHWVRQAPGKGLEWVTFISYDGNNKYYADSVKGRFTISRDDSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 985 - protein, 118 aa, Artificial Sequence
  Description of Artificial Sequence: Synthetic polypeptide
  VH of XENP019837
QVQLVESGGGVVQPGRSLRLSCAASGFTFSSYTMHWVRQAPGKGLEWVTFISYDGNNKYYADSVKGRFTISRDDSKNTLYLQMNSLRAEDTAIYYCARTGWLGPFDYWGQGTLVTVSS

SEQ ID NO: 986 - protein, 108 aa, Artificial Sequence; identical to SEQ ID NO: 23
  Description of Artificial Sequence: Synthetic polypeptide
  VL of XENP019837

SEQ ID NO: 987 - protein, 5 aa, Artificial Sequence
  Description of Artificial Sequence: Synthetic peptide
  XENP019837 vhCDR1
SYTMH

SEQ ID NO: 988 - protein, 17 aa, Artificial Sequence
  Description of Artificial Sequence: Synthetic peptide
  XENP019837 vhCDR2
FISYDGNNKYYADSVKG

SEQ ID NO: 989 - protein, 9 aa, Artificial Sequence
  Description of Artificial Sequence: Synthetic peptide
  XENP019837 vhCDR3
TGWLGPFDY

SEQ ID NO: 990 - protein, 12 aa, Artificial Sequence
  Description of Artificial Sequence: Synthetic peptide
  XENP019837 vlCDR1
RASQSVGSSYLA

SEQ ID NO: 991 - protein, 7 aa, Artificial Sequence
  Description of Artificial Sequence: Synthetic peptide
  XENP019837 vlCDR2
GAFSRAT

SEQ ID NO: 992 - protein, 9 aa, Artificial Sequence
  Description of Artificial Sequence: Synthetic peptide
  XENP019837 vlCDR3
QQYGSSPWT

SEQ ID NO: 993 - protein, 246 aa, Artificial Sequence
  Description of Artificial Sequence: Synthetic polypeptide
  XENP019838 [CTLA-4]_H0.90_L0_scFv(GKPGS)4
QVQLVESGGGVVQPGRSLRLSCAASGFTFSSYTMHWVRQAPGKGLEWVTFISYDGNNKYYADSVKGRFTISRDNAKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 994 - protein, 118 aa, Artificial Sequence
  Description of Artificial Sequence: Synthetic polypeptide
  VH of XENP019838
QVQLVESGGGVVQPGRSLRLSCAASGFTFSSYTMHWVRQAPGKGLEWVTFISYDGNNKYYADSVKGRFTISRDNAKNTLYLQMNSLRAEDTAIYYCARTGWLGPFDYWGQGTLVTVSS

SEQ ID NO: 995 - protein, 108 aa, Artificial Sequence; identical to SEQ ID NO: 23
  Description of Artificial Sequence: Synthetic polypeptide
  VL of XENP019838

SEQ ID NO: 996 - protein, 5 aa, Artificial Sequence
  Description of Artificial Sequence: Synthetic peptide
  XENP019838 vhCDR1
SYTMH

SEQ ID NO: 997 - protein, 17 aa, Artificial Sequence
  Description of Artificial Sequence: Synthetic peptide
  XENP019838 vhCDR2
FISYDGNNKYYADSVKG

SEQ ID NO: 998 - protein, 9 aa, Artificial Sequence
  Description of Artificial Sequence: Synthetic peptide
  XENP019838 vhCDR3
TGWLGPFDY

SEQ ID NO: 999 - protein, 12 aa, Artificial Sequence
  Description of Artificial Sequence: Synthetic peptide
  XENP019838 vlCDR1
RASQSVGSSYLA

SEQ ID NO: 1000 - protein, 7 aa, Artificial Sequence
  Description of Artificial Sequence: Synthetic peptide
  XENP019838 vlCDR2
GAFSRAT

SEQ ID NO: 1001 - protein, 9 aa, Artificial Sequence
  Description of Artificial Sequence: Synthetic peptide
  XENP019838 vlCDR3
QQYGSSPWT

SEQ ID NO: 1002 - protein, 246 aa, Artificial Sequence
  Description of Artificial Sequence: Synthetic polypeptide
  XENP019839 [CTLA-4]_H0.91_L0_scFv(GKPGS)4
QVQLVESGGGVVQPGRSLRLSCAASGFTFSSYTMHWVRQAPGKGLEWVTFISYDGNNKYYADSVKGRFTISRDNSRNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1003 - protein, 118 aa, Artificial Sequence
  Description of Artificial Sequence: Synthetic polypeptide
  VH of XENP019839
QVQLVESGGGVVQPGRSLRLSCAASGFTFSSYTMHWVRQAPGKGLEWVTFISYDGNNKYYADSVKGRFTISRDNSRNTLYLQMNSLRAEDTAIYYCARTGWLGPFDYWGQGTLVTVSS

SEQ ID NO: 1004 - protein, 108 aa, Artificial Sequence; identical to SEQ ID NO: 23
  Description of Artificial Sequence: Synthetic polypeptide
  VL of XENP019839

SEQ ID NO: 1005 - protein, 5 aa, Artificial Sequence
  Description of Artificial Sequence: Synthetic peptide
  XENP019839 vhCDR1
SYTMH

SEQ ID NO: 1006 - protein, 17 aa, Artificial Sequence
  Description of Artificial Sequence: Synthetic peptide
  XENP019839 vhCDR2
FISYDGNNKYYADSVKG

SEQ ID NO: 1007 - protein, 9 aa, Artificial Sequence
  Description of Artificial Sequence: Synthetic peptide
  XENP019839 vhCDR3
TGWLGPFDY

SEQ ID NO: 1008 - protein, 12 aa, Artificial Sequence
  Description of Artificial Sequence: Synthetic peptide
  XENP019839 vlCDR1
RASQSVGSSYLA

SEQ ID NO: 1009 - protein, 7 aa, Artificial Sequence
  Description of Artificial Sequence: Synthetic peptide
  XENP019839 vlCDR2
GAFSRAT

SEQ ID NO: 1010 - protein, 9 aa, Artificial Sequence
  Description of Artificial Sequence: Synthetic peptide
  XENP019839 vlCDR3
QQYGSSPWT

SEQ ID NO: 1011 - protein, 246 aa, Artificial Sequence
  Description of Artificial Sequence: Synthetic polypeptide
  XENP019840 [CTLA-4]_H0.92_L0_scFv(GKPGS)4
QVQLVESGGGVVQPGRSLRLSCAASGFTFSSYTMHWVRQAPGKGLEWVTFISYDGNNKYYADSVKGRFTISRDNSKNSLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1012 - protein, 118 aa, Artificial Sequence
  Description of Artificial Sequence: Synthetic polypeptide
  VH of XENP019840
QVQLVESGGGVVQPGRSLRLSCAASGFTFSSYTMHWVRQAPGKGLEWVTFISYDGNNKYYADSVKGRFTISRDNSKNSLYLQMNSLRAEDTAIYYCARTGWLGPFDYWGQGTLVTVSS

SEQ ID NO: 1013 - protein, 108 aa, Artificial Sequence; identical to SEQ ID NO: 23
  Description of Artificial Sequence: Synthetic polypeptide
  VL of XENP019840

SEQ ID NO: 1014 - protein, 5 aa, Artificial Sequence
  Description of Artificial Sequence: Synthetic peptide
  XENP019840 vhCDR1
SYTMH

SEQ ID NO: 1015 - protein, 17 aa, Artificial Sequence
  Description of Artificial Sequence: Synthetic peptide
  XENP019840 vhCDR2
FISYDGNNKYYADSVKG

SEQ ID NO: 1016 - protein, 9 aa, Artificial Sequence
  Description of Artificial Sequence: Synthetic peptide
  XENP019840 vhCDR3
TGWLGPFDY

SEQ ID NO: 1017 - protein, 12 aa, Artificial Sequence
  Description of Artificial Sequence: Synthetic peptide
  XENP019840 vlCDR1
RASQSVGSSYLA

SEQ ID NO: 1018 - protein, 7 aa, Artificial Sequence
  Description of Artificial Sequence: Synthetic peptide
  XENP019840 vlCDR2
GAFSRAT

SEQ ID NO: 1019 - protein, 9 aa, Artificial Sequence
  Description of Artificial Sequence: Synthetic peptide
  XENP019840 vlCDR3
QQYGSSPWT

SEQ ID NO: 1020 - protein, 246 aa, Artificial Sequence
  Description of Artificial Sequence: Synthetic polypeptide
  XENP019841 [CTLA-4]_H0.93_L0_scFv(GKPGS)4
QVQLVESGGGVVQPGRSLRLSCAASGFTFSSYTMHWVRQAPGKGLEWVTFISYDGNNKYYADSVKGRFTISRDNSKNQLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1021 - protein, 118 aa, Artificial Sequence
  Description of Artificial Sequence: Synthetic polypeptide
  VH of XENP019841
QVQLVESGGGVVQPGRSLRLSCAASGFTFSSYTMHWVRQAPGKGLEWVTFISYDGNNKYYADSVKGRFTISRDNSKNQLYLQMNSLRAEDTAIYYCARTGWLGPFDYWGQGTLVTVSS

SEQ ID NO: 1022 - protein, 108 aa, Artificial Sequence; identical to SEQ ID NO: 23
  Description of Artificial Sequence: Synthetic polypeptide
  VL of XENP019841

SEQ ID NO: 1023 - protein, 5 aa, Artificial Sequence
  Description of Artificial Sequence: Synthetic peptide
  XENP019841 vhCDR1
SYTMH

SEQ ID NO: 1024 - protein, 17 aa, Artificial Sequence
  Description of Artificial Sequence: Synthetic peptide
  XENP019841 vhCDR2
FISYDGNNKYYADSVKG

SEQ ID NO: 1025 - protein, 9 aa, Artificial Sequence
  Description of Artificial Sequence: Synthetic peptide
  XENP019841 vhCDR3
TGWLGPFDY

SEQ ID NO: 1026 - protein, 12 aa, Artificial Sequence
  Description of Artificial Sequence: Synthetic peptide
  XENP019841 vlCDR1
RASQSVGSSYLA

SEQ ID NO: 1027 - protein, 7 aa, Artificial Sequence
  Description of Artificial Sequence: Synthetic peptide
  XENP019841 vlCDR2
GAFSRAT

SEQ ID NO: 1028 - protein, 9 aa, Artificial Sequence
  Description of Artificial Sequence: Synthetic peptide
  XENP019841 vlCDR3
QQYGSSPWT

SEQ ID NO: 1029 - protein, 246 aa, Artificial Sequence
  Description of Artificial Sequence: Synthetic polypeptide
  XENP019842 [CTLA-4]_H0.94_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLEMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1030 - protein, 118 aa, Artificial Sequence
  Description of Artificial Sequence: Synthetic polypeptide
  VH of XENP019842
QVQLVESGGGVVQPGRSLRLSCAASGFTFSSYTMHWVRQAPGKGLEWVTFISYDGNNKYYADSVKGRFTISRDNSKNTLYLEMNSLRAEDTAIYYCARTGWLGPFDYWGQGTLVTVSS

SEQ ID NO: 1031 - protein, 108 aa, Artificial Sequence; identical to SEQ ID NO: 23
  Description of Artificial Sequence: Synthetic polypeptide
  VL of XENP019842

SEQ ID NO: 1032 - protein, 5 aa, Artificial Sequence
  Description of Artificial Sequence: Synthetic peptide
  XENP019842 vhCDR1
SYTMH

SEQ ID NO: 1033 - protein, 17 aa, Artificial Sequence
  Description of Artificial Sequence: Synthetic peptide
  XENP019842 vhCDR2
FISYDGNNKYYADSVKG

SEQ ID NO: 1034 - protein, 9 aa, Artificial Sequence
  Description of Artificial Sequence: Synthetic peptide
  XENP019842 vhCDR3
TGWLGPFDY

SEQ ID NO: 1035 - protein, 12 aa, Artificial Sequence
  Description of Artificial Sequence: Synthetic peptide
  XENP019842 vlCDR1
RASQSVGSSYLA

SEQ ID NO: 1036 - protein, 7 aa, Artificial Sequence
  Description of Artificial Sequence: Synthetic peptide
  XENP019842 vlCDR2
GAFSRAT

SEQ ID NO: 1037 - protein, 9 aa, Artificial Sequence
  Description of Artificial Sequence: Synthetic peptide
  XENP019842 vlCDR3
QQYGSSPWT

SEQ ID NO: 1038 - protein, 246 aa, Artificial Sequence
  Description of Artificial Sequence: Synthetic polypeptide
  XENP019843 [CTLA-4]_H0.95_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMDSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1039 - protein, 118 aa, Artificial Sequence
  Description of Artificial Sequence: Synthetic polypeptide
  VH of XENP019843
QVQLVESGGGVVQPGRSLRLSCAASGFTFSSYTMHWVRQAPGKGLEWVTFISYDGNNKYYADSVKGRFTISRDNSKNTLYLQMDSLRAEDTAIYYCARTGWLGPFDYWGQGTLVTVSS

SEQ ID NO: 1040 - protein, 108 aa, Artificial Sequence; identical to SEQ ID NO: 23
  Description of Artificial Sequence: Synthetic polypeptide
  VL of XENP019843

SEQ ID NO: 1041 - protein, 5 aa, Artificial Sequence
  Description of Artificial Sequence: Synthetic peptide
  XENP019843 vhCDR1
SYTMH

SEQ ID NO: 1042 - protein, 17 aa, Artificial Sequence
  Description of Artificial Sequence: Synthetic peptide
  XENP019843 vhCDR2
FISYDGNNKYYADSVKG

SEQ ID NO: 1043 - protein, 9 aa, Artificial Sequence
  Description of Artificial Sequence: Synthetic peptide
  XENP019843 vhCDR3
TGWLGPFDY

SEQ ID NO: 1044 - protein, 12 aa, Artificial Sequence
  Description of Artificial Sequence: Synthetic peptide
  XENP019843 vlCDR1
RASQSVGSSYLA

SEQ ID NO: 1045 - protein, 7 aa, Artificial Sequence
  Description of Artificial Sequence: Synthetic peptide
  XENP019843 vlCDR2
GAFSRAT

SEQ ID NO: 1046 - protein, 9 aa, Artificial Sequence
  Description of Artificial Sequence: Synthetic peptide
  XENP019843 vlCDR3
QQYGSSPWT

SEQ ID NO: 1047 - protein, 246 aa, Artificial Sequence
  Description of Artificial Sequence: Synthetic polypeptide
  XENP019844 [CTLA-4]_H0.96_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNDLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1048 - protein, 118 aa, Artificial Sequence
  Description of Artificial Sequence: Synthetic polypeptide
  VH of XENP019844
QVQLVESGGGVVQPGRSLRLSCAASGFTFSSYTMHWVRQAPGKGLEWVTFISYDGNNKYYADSVKGRFTISRDNSKNTLYLQMNDLRAEDTAIYYCARTGWLGPFDYWGQGTLVTVSS

SEQ ID NO: 1049 - protein, 108 aa, Artificial Sequence; identical to SEQ ID NO: 23
  Description of Artificial Sequence: Synthetic polypeptide
  VL of XENP019844

SEQ ID NO: 1050 - protein, 5 aa, Artificial Sequence
  Description of Artificial Sequence: Synthetic peptide
  XENP019844 vhCDR1
SYTMH

SEQ ID NO: 1051 - protein, 17 aa, Artificial Sequence
  Description of Artificial Sequence: Synthetic peptide
  XENP019844 vhCDR2
FISYDGNNKYYADSVKG

SEQ ID NO: 1052 - protein, 9 aa, Artificial Sequence
  Description of Artificial Sequence: Synthetic peptide
  XENP019844 vhCDR3
TGWLGPFDY

SEQ ID NO: 1053 - protein, 12 aa, Artificial Sequence
  Description of Artificial Sequence: Synthetic peptide
  XENP019844 vlCDR1
RASQSVGSSYLA

SEQ ID NO: 1054 - protein, 7 aa, Artificial Sequence
  Description of Artificial Sequence: Synthetic peptide
  XENP019844 vlCDR2
GAFSRAT

SEQ ID NO: 1055 - protein, 9 aa, Artificial Sequence
  Description of Artificial Sequence: Synthetic peptide
  XENP019844 vlCDR3
QQYGSSPWT

SEQ ID NO: 1056 - protein, 246 aa, Artificial Sequence
  Description of Artificial Sequence: Synthetic polypeptide
  XENP019845 [CTLA-4]_H0.97_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRTEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1057 - protein, 118 aa, Artificial Sequence
  Description of Artificial Sequence: Synthetic polypeptide
  VH of XENP019845
QVQLVESGGGVVQPGRSLRLSCAASGFTFSSYTMHWVRQAPGKGLEWVTFISYDGNNKYYADSVKGRFTISRDNSKNTLYLQMNSLRTEDTAIYYCARTGWLGPFDYWGQGTLVTVSS

SEQ ID NO: 1058 - protein, 108 aa, Artificial Sequence; identical to SEQ ID NO: 23
  Description of Artificial Sequence: Synthetic polypeptide
  VL of XENP019845

SEQ ID NO: 1059 - protein, 5 aa, Artificial Sequence
  Description of Artificial Sequence: Synthetic peptide
  XENP019845 vhCDR1
SYTMH

SEQ ID NO: 1060 - protein, 17 aa, Artificial Sequence
  Description of Artificial Sequence: Synthetic peptide
  XENP019845 vhCDR2
FISYDGNNKYYADSVKG

SEQ ID NO: 1061 - protein, 9 aa, Artificial Sequence
  Description of Artificial Sequence: Synthetic peptide
  XENP019845 vhCDR3
TGWLGPFDY

SEQ ID NO: 1062 - protein, 12 aa, Artificial Sequence
  Description of Artificial Sequence: Synthetic peptide
  XENP019845 vlCDR1
RASQSVGSSYLA

SEQ ID NO: 1063 - protein, 7 aa, Artificial Sequence
  Description of Artificial Sequence: Synthetic peptide
  XENP019845 vlCDR2
GAFSRAT

SEQ ID NO: 1064 - protein, 9 aa, Artificial Sequence
  Description of Artificial Sequence: Synthetic peptide
  XENP019845 vlCDR3
QQYGSSPWT

SEQ ID NO: 1065 - protein, 246 aa, Artificial Sequence
  Description of Artificial Sequence: Synthetic polypeptide
  XENP019846 [CTLA-4]_H0.98_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTALYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1066 - protein, 118 aa, Artificial Sequence
  Description of Artificial Sequence: Synthetic polypeptide
  VH of XENP019846
QVQLVESGGGVVQPGRSLRLSCAASGFTFSSYTMHWVRQAPGKGLEWVTFISYDGNNKYYADSVKGRFTISRDNSKNTLYLQMNSLRAEDTALYYCARTGWLGPFDYWGQGTLVTVSS

SEQ ID NO: 1067 - protein, 108 aa, Artificial Sequence; identical to SEQ ID NO: 23
  Description of Artificial Sequence: Synthetic polypeptide
  VL of XENP019846

SEQ ID NO: 1068 - protein, 5 aa, Artificial Sequence
  Description of Artificial Sequence: Synthetic peptide
  XENP019846 vhCDR1
SYTMH

SEQ ID NO: 1069 - protein, 17 aa, Artificial Sequence
  Description of Artificial Sequence: Synthetic peptide
  XENP019846 vhCDR2
FISYDGNNKYYADSVKG

SEQ ID NO: 1070 - protein, 9 aa, Artificial Sequence
  Description of Artificial Sequence: Synthetic peptide
  XENP019846 vhCDR3
TGWLGPFDY

SEQ ID NO: 1071 - protein, 12 aa, Artificial Sequence
  Description of Artificial Sequence: Synthetic peptide
  XENP019846 vlCDR1
RASQSVGSSYLA

SEQ ID NO: 1072 - protein, 7 aa, Artificial Sequence
  Description of Artificial Sequence: Synthetic peptide
  XENP019846 vlCDR2
GAFSRAT

SEQ ID NO: 1073 - protein, 9 aa, Artificial Sequence
  Description of Artificial Sequence: Synthetic peptide
  XENP019846 vlCDR3
QQYGSSPWT

SEQ ID NO: 1074 - protein, 246 aa, Artificial Sequence
  Description of Artificial Sequence: Synthetic polypeptide
  XENP019847 [CTLA-4]_H0.99_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAVYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1075 - protein, 118 aa, Artificial Sequence
  Description of Artificial Sequence: Synthetic polypeptide
  VH of XENP019847
QVQLVESGGGVVQPGRSLRLSCAASGFTFSSYTMHWVRQAPGKGLEWVTFISYDGNNKYYADSVKGRFTISRDNSKNTLYLQMNSLRAEDTAVYYCARTGWLGPFDYWGQGTLVTVSS

SEQ ID NO: 1076 - protein, 108 aa, Artificial Sequence; identical to SEQ ID NO: 23
  Description of Artificial Sequence: Synthetic polypeptide
  VL of XENP019847

SEQ ID NO: 1077 - protein, 5 aa, Artificial Sequence
  Description of Artificial Sequence: Synthetic peptide
  XENP019847 vhCDR1
SYTMH

SEQ ID NO: 1078 - protein, 17 aa, Artificial Sequence
  Description of Artificial Sequence: Synthetic peptide
  XENP019847 vhCDR2
FISYDGNNKYYADSVKG

SEQ ID NO: 1079 - protein, 9 aa, Artificial Sequence
  Description of Artificial Sequence: Synthetic peptide
  XENP019847 vhCDR3
TGWLGPFDY

SEQ ID NO: 1080 - protein, 12 aa, Artificial Sequence
  Description of Artificial Sequence: Synthetic peptide
  XENP019847 vlCDR1
RASQSVGSSYLA

SEQ ID NO: 1081 - protein, 7 aa, Artificial Sequence
  Description of Artificial Sequence: Synthetic peptide
  XENP019847 vlCDR2
GAFSRAT

SEQ ID NO: 1082 - protein, 9 aa, Artificial Sequence
  Description of Artificial Sequence: Synthetic peptide
  XENP019847 vlCDR3
QQYGSSPWT

SEQ ID NO: 1083 - protein, 246 aa, Artificial Sequence
  Description of Artificial Sequence: Synthetic polypeptide
  XENP019848 [CTLA-4]_H0.100_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCTRTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1084 - protein, 118 aa, Artificial Sequence
  Description of Artificial Sequence: Synthetic polypeptide
  VH of XENP019848
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCTRTGWLGPFDYWGQGTLVTVSS

SEQ ID NO: 1085 - protein, 108 aa, Artificial Sequence; identical to SEQ ID NO: 23
  Description of Artificial Sequence: Synthetic polypeptide
  VL of XENP019848

SEQ ID NO: 1086 - protein, 5 aa, Artificial Sequence
  Description of Artificial Sequence: Synthetic peptide
  XENP019848 vhCDR1
SYTMH

SEQ ID NO: 1087 - protein, 17 aa, Artificial Sequence
  Description of Artificial Sequence: Synthetic peptide
  XENP019848 vhCDR2
FISYDGNNKYYADSVKG

SEQ ID NO: 1088 - protein, 9 aa, Artificial Sequence
  Description of Artificial Sequence: Synthetic peptide
  XENP019848 vhCDR3
TGWLGPFDY

SEQ ID NO: 1089 - protein, 12 aa, Artificial Sequence
  Description of Artificial Sequence: Synthetic peptide
  XENP019848 vlCDR1
RASQSVGSSYLA

SEQ ID NO: 1090 - protein, 7 aa, Artificial Sequence
  Description of Artificial Sequence: Synthetic peptide
  XENP019848 vlCDR2
GAFSRAT

SEQ ID NO: 1091 - protein, 9 aa, Artificial Sequence
  Description of Artificial Sequence: Synthetic peptide
  XENP019848 vlCDR3
QQYGSSPWT

SEQ ID NO: 1092 - protein, 246 aa, Artificial Sequence
  Description of Artificial Sequence: Synthetic polypeptide
  XENP019849 [CTLA-4]_H0.101_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCAKTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1093 - protein, 118 aa, Artificial Sequence
  Description of Artificial Sequence: Synthetic polypeptide
  VH of XENP019849
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCAKTGWLGPFDYWGQGTLVTVSS

SEQ ID NO: 1094 - protein, 108 aa, Artificial Sequence; identical to SEQ ID NO: 23
  Description of Artificial Sequence: Synthetic polypeptide
  VL of XENP019849

SEQ ID NO: 1095 - protein, 5 aa, Artificial Sequence
  Description of Artificial Sequence: Synthetic peptide
  XENP019849 vhCDR1
SYTMH

SEQ ID NO: 1096 - protein, 17 aa, Artificial Sequence
  Description of Artificial Sequence: Synthetic peptide
  XENP019849 vhCDR2
FISYDGNNKYYADSVKG

SEQ ID NO: 1097 - protein, 9 aa, Artificial Sequence
  Description of Artificial Sequence: Synthetic peptide
  XENP019849 vhCDR3
TGWLGPFDY

SEQ ID NO: 1098 - protein, 12 aa, Artificial Sequence
  Description of Artificial Sequence: Synthetic peptide
  XENP019849 vlCDR1
RASQSVGSSYLA

SEQ ID NO: 1099 - protein, 7 aa, Artificial Sequence
  Description of Artificial Sequence: Synthetic peptide
  XENP019849 vlCDR2
GAFSRAT

SEQ ID NO: 1100 - protein, 9 aa, Artificial Sequence
  Description of Artificial Sequence: Synthetic peptide
  XENP019849 vlCDR3
QQYGSSPWT

SEQ ID NO: 1101 - protein, 246 aa, Artificial Sequence
  Description of Artificial Sequence: Synthetic polypeptide
  XENP019850 [CTLA-4]_H0.102_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARAGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1102 - protein, 118 aa, Artificial Sequence
  Description of Artificial Sequence: Synthetic polypeptide
  VH of XENP019850
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARAGWLGPFDYWGQGTLVTVSS

SEQ ID NO: 1103 - protein, 108 aa, Artificial Sequence; identical to SEQ ID NO: 23
  Description of Artificial Sequence: Synthetic polypeptide
  VL of XENP019850

SEQ ID NO: 1104 - protein, 5 aa, Artificial Sequence
  Description of Artificial Sequence: Synthetic peptide
  XENP019850 vhCDR1
SYTMH

SEQ ID NO: 1105 - protein, 17 aa, Artificial Sequence
  Description of Artificial Sequence: Synthetic peptide
  XENP019850 vhCDR2
FISYDGNNKYYADSVKG

SEQ ID NO: 1106 - protein, 9 aa, Artificial Sequence
  Description of Artificial Sequence: Synthetic peptide
  XENP019850 vhCDR3
AGWLGPFDY

SEQ ID NO: 1107 - protein, 12 aa, Artificial Sequence
  Description of Artificial Sequence: Synthetic peptide
  XENP019850 vlCDR1
RASQSVGSSYLA

SEQ ID NO: 1108 - protein, 7 aa, Artificial Sequence
  Description of Artificial Sequence: Synthetic peptide
  XENP019850 vlCDR2
GAFSRAT

SEQ ID NO: 1109 - protein, 9 aa, Artificial Sequence
  Description of Artificial Sequence: Synthetic peptide
  XENP019850 vlCDR3
QQYGSSPWT

SEQ ID NO: 1110 - protein, 246 aa, Artificial Sequence
  Description of Artificial Sequence: Synthetic polypeptide
  XENP019851 [CTLA-4]_H0.103_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARGGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1111 - protein, 118 aa, Artificial Sequence
  Description of Artificial Sequence: Synthetic polypeptide
  VH of XENP019851
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARGGWLGPFDYWGQGTLVTVSS

SEQ ID NO: 1112 - protein, 108 aa, Artificial Sequence; identical to SEQ ID NO: 23
  Description of Artificial Sequence: Synthetic polypeptide
  VL of XENP019851

SEQ ID NO: 1113 - protein, 5 aa, Artificial Sequence
  Description of Artificial Sequence: Synthetic peptide
  XENP019851 vhCDR1
SYTMH

SEQ ID NO: 1114 - protein, 17 aa, Artificial Sequence
  Description of Artificial Sequence: Synthetic peptide
  XENP019851 vhCDR2
FISYDGNNKYYADSVKG

SEQ ID NO: 1115 - protein, 9 aa, Artificial Sequence
  Description of Artificial Sequence: Synthetic peptide
  XENP019851 vhCDR3
GGWLGPFDY

SEQ ID NO: 1116 - protein, 12 aa, Artificial Sequence
  Description of Artificial Sequence: Synthetic peptide
  XENP019851 vlCDR1
RASQSVGSSYLA

SEQ ID NO: 1117 - protein, 7 aa, Artificial Sequence
  Description of Artificial Sequence: Synthetic peptide
  XENP019851 vlCDR2
GAFSRAT

SEQ ID NO: 1118 - protein, 9 aa, Artificial Sequence
  Description of Artificial Sequence: Synthetic peptide
  XENP019851 vlCDR3
QQYGSSPWT

SEQ ID NO: 1119 - protein, 246 aa, Artificial Sequence
  Description of Artificial Sequence: Synthetic polypeptide
  XENP019852 [CTLA-4]_H0.104_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARDGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1120 - protein, 118 aa, Artificial Sequence
  Description of Artificial Sequence: Synthetic polypeptide
  VH of XENP019852
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARDGWLGPFDYWGQGTLVTVSS

SEQ ID NO: 1121 - protein, 108 aa, Artificial Sequence; identical to SEQ ID NO: 23
  Description of Artificial Sequence: Synthetic polypeptide
  VL of XENP019852

SEQ ID NO: 1122 - protein, 5 aa, Artificial Sequence
  Description of Artificial Sequence: Synthetic peptide
  XENP019852 vhCDR1
SYTMH

SEQ ID NO: 1123 - protein, 17 aa, Artificial Sequence
  Description of Artificial Sequence: Synthetic peptide
  XENP019852 vhCDR2
FISYDGNNKYYADSVKG

SEQ ID NO: 1124 - protein, 9 aa, Artificial Sequence
  Description of Artificial Sequence: Synthetic peptide
  XENP019852 vhCDR3
DGWLGPFDY

SEQ ID NO: 1125 - protein, 12 aa, Artificial Sequence
  Description of Artificial Sequence: Synthetic peptide
  XENP019852 vlCDR1
RASQSVGSSYLA

SEQ ID NO: 1126 - protein, 7 aa, Artificial Sequence
  Description of Artificial Sequence: Synthetic peptide
  XENP019852 vlCDR2
GAFSRAT

SEQ ID NO: 1127 - protein, 9 aa, Artificial Sequence
  Description of Artificial Sequence: Synthetic peptide
  XENP019852 vlCDR3
QQYGSSPWT

SEQ ID NO: 1128 - protein, 246 aa, Artificial Sequence
  Description of Artificial Sequence: Synthetic polypeptide
  XENP019853 [CTLA-4]_H0.105_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARSGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1129 - protein, 118 aa, Artificial Sequence
  Description of Artificial Sequence: Synthetic polypeptide
  VH of XENP019853
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARSGWLGPFDYWGQGTLVTVSS

SEQ ID NO: 1130 - protein, 108 aa, Artificial Sequence; identical to SEQ ID NO: 23
  Description of Artificial Sequence: Synthetic polypeptide
  VL of XENP019853

SEQ ID NO: 1131 - protein, 5 aa, Artificial Sequence
  Description of Artificial Sequence: Synthetic peptide
  XENP019853 vhCDR1
SYTMH

SEQ ID NO: 1132 - protein, 17 aa, Artificial Sequence
  Description of Artificial Sequence: Synthetic peptide
  XENP019853 vhCDR2
FISYDGNNKYYADSVKG

SEQ ID NO: 1133 - protein, 9 aa, Artificial Sequence
  Description of Artificial Sequence: Synthetic peptide
  XENP019853 vhCDR3
SGWLGPFDY

SEQ ID NO: 1134 - protein, 12 aa, Artificial Sequence
  Description of Artificial Sequence: Synthetic peptide
  XENP019853 vlCDR1
RASQSVGSSYLA

SEQ ID NO: 1135 - protein, 7 aa, Artificial Sequence
  Description of Artificial Sequence: Synthetic peptide
  XENP019853 vlCDR2
GAFSRAT

SEQ ID NO: 1136 - protein, 9 aa, Artificial Sequence
  Description of Artificial Sequence: Synthetic peptide
  XENP019853 vlCDR3
QQYGSSPWT

SEQ ID NO: 1137 - protein, 246 aa, Artificial Sequence
  Description of Artificial Sequence: Synthetic polypeptide
  XENP019854 [CTLA-4]_H0.106_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARVGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1138 - protein, 118 aa, Artificial Sequence
  Description of Artificial Sequence: Synthetic polypeptide
  VH of XENP019854
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARVGWLGPFDYWGQGTLVTVSS

SEQ ID NO: 1139 - protein, 108 aa, Artificial Sequence; identical to SEQ ID NO: 23
  Description of Artificial Sequence: Synthetic polypeptide
  VL of XENP019854

SEQ ID NO: 1140 - protein, 5 aa, Artificial Sequence
  Description of Artificial Sequence: Synthetic peptide
  XENP019854 vhCDR1
SYTMH

SEQ ID NO: 1141 - protein, 17 aa, Artificial Sequence
  Description of Artificial Sequence: Synthetic peptide
  XENP019854 vhCDR2
FISYDGNNKYYADSVKG

SEQ ID NO: 1142 - protein, 9 aa, Artificial Sequence
  Description of Artificial Sequence: Synthetic peptide
  XENP019854 vhCDR3
VGWLGPFDY

SEQ ID NO: 1143 - protein, 12 aa, Artificial Sequence
  Description of Artificial Sequence: Synthetic peptide
  XENP019854 vlCDR1
RASQSVGSSYLA

SEQ ID NO: 1144 - protein, 7 aa, Artificial Sequence
  Description of Artificial Sequence: Synthetic peptide
  XENP019854 vlCDR2
GAFSRAT

SEQ ID NO: 1145 - protein, 9 aa, Artificial Sequence
  Description of Artificial Sequence: Synthetic peptide
  XENP019854 vlCDR3
QQYGSSPWT

SEQ ID NO: 1146 - protein, 246 aa, Artificial Sequence
  Description of Artificial Sequence: Synthetic polypeptide
  XENP019855 [CTLA-4]_H0.107_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARYGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1147 - protein, 118 aa, Artificial Sequence
  Description of Artificial Sequence: Synthetic polypeptide
  VH of XENP019855
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARYGWLGPFDYWGQGTLVTVSS

SEQ ID NO: 1148 - protein, 108 aa, Artificial Sequence; identical to SEQ ID NO: 23
  Description of Artificial Sequence: Synthetic polypeptide
  VL of XENP019855

SEQ ID NO: 1149 - protein, 5 aa, Artificial Sequence
  Description of Artificial Sequence: Synthetic peptide
  XENP019855 vhCDR1
SYTMH

SEQ ID NO: 1150 - protein, 17 aa, Artificial Sequence
  Description of Artificial Sequence: Synthetic peptide
  XENP019855 vhCDR2
FISYDGNNKYYADSVKG

SEQ ID NO: 1151 - protein, 9 aa, Artificial Sequence
  Description of Artificial Sequence: Synthetic peptide
  XENP019855 vhCDR3
YGWLGPFDY

SEQ ID NO: 1152 - protein, 12 aa, Artificial Sequence
  Description of Artificial Sequence: Synthetic peptide
  XENP019855 vlCDR1
RASQSVGSSYLA

SEQ ID NO: 1153 - protein, 7 aa, Artificial Sequence
  Description of Artificial Sequence: Synthetic peptide
  XENP019855 vlCDR2
GAFSRAT

SEQ ID NO: 1154 - protein, 9 aa, Artificial Sequence
  Description of Artificial Sequence: Synthetic peptide
  XENP019855 vlCDR3
QQYGSSPWT

SEQ ID NO: 1155 - protein, 246 aa, Artificial Sequence
  Description of Artificial Sequence: Synthetic polypeptide
  XENP019856 [CTLA-4]_H0.108_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTAWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1156 - protein, 118 aa, Artificial Sequence
  Description of Artificial Sequence: Synthetic polypeptide
  VH of XENP019856
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTAWLGPFDYWGQGTLVTVSS

SEQ ID NO: 1157 - protein, 108 aa, Artificial Sequence; identical to SEQ ID NO: 23
  Description of Artificial Sequence: Synthetic polypeptide
  VL of XENP019856

SEQ ID NO: 1158 - protein, 5 aa, Artificial Sequence
  Description of Artificial Sequence: Synthetic peptide
  XENP019856 vhCDR1
SYTMH

SEQ ID NO: 1159 - protein, 17 aa, Artificial Sequence
  Description of Artificial Sequence: Synthetic peptide
  XENP019856 vhCDR2
FISYDGNNKYYADSVKG

SEQ ID NO: 1160 - protein, 9 aa, Artificial Sequence
  Description of Artificial Sequence: Synthetic peptide
  XENP019856 vhCDR3
TAWLGPFDY

SEQ ID NO: 1161 - protein, 12 aa, Artificial Sequence
  Description of Artificial Sequence: Synthetic peptide
  XENP019856 vlCDR1
RASQSVGSSYLA

SEQ ID NO: 1162 - protein, 7 aa, Artificial Sequence
  Description of Artificial Sequence: Synthetic peptide
  XENP019856 vlCDR2
GAFSRAT

SEQ ID NO: 1163 - protein, 9 aa, Artificial Sequence
  Description of Artificial Sequence: Synthetic peptide
  XENP019856 vlCDR3
QQYGSSPWT

SEQ ID NO: 1164 - protein, 246 aa, Artificial Sequence
  Description of Artificial Sequence: Synthetic polypeptide
  XENP019857 [CTLA-4]_H0.109_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTSWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1165 - protein, 118 aa, Artificial Sequence
  Description of Artificial Sequence: Synthetic polypeptide
  VH of XENP019857
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTSWLGPFDYWGQGTLVTVSS

SEQ ID NO: 1166 - protein, 108 aa, Artificial Sequence; identical to SEQ ID NO: 23
  Description of Artificial Sequence: Synthetic polypeptide
  VL of XENP019857

SEQ ID NO: 1167 - protein, 5 aa, Artificial Sequence
  Description of Artificial Sequence: Synthetic peptide
  XENP019857 vhCDR1
SYTMH

SEQ ID NO: 1168 - protein, 17 aa, Artificial Sequence
  Description of Artificial Sequence: Synthetic peptide
  XENP019857 vhCDR2
FISYDGNNKYYADSVKG

SEQ ID NO: 1169 - protein, 9 aa, Artificial Sequence
  Description of Artificial Sequence: Synthetic peptide
  XENP019857 vhCDR3
TSWLGPFDY

SEQ ID NO: 1170 - protein, 12 aa, Artificial Sequence
  Description of Artificial Sequence: Synthetic peptide
  XENP019857 vlCDR1
RASQSVGSSYLA

SEQ ID NO: 1171 - protein, 7 aa, Artificial Sequence
  Description of Artificial Sequence: Synthetic peptide
  XENP019857 vlCDR2
GAFSRAT

SEQ ID NO: 1172 - protein, 9 aa, Artificial Sequence
  Description of Artificial Sequence: Synthetic peptide
  XENP019857 vlCDR3
QQYGSSPWT

SEQ ID NO: 1173 - protein, 246 aa, Artificial Sequence
  Description of Artificial Sequence: Synthetic polypeptide
  XENP019858 [CTLA-4]_H0.110_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTTWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1174 - protein, 118 aa, Artificial Sequence
  Description of Artificial Sequence: Synthetic polypeptide
  VH of XENP019858
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTTWLGPFDYWGQGTLVTVSS

SEQ ID NO: 1175 - protein, 108 aa, Artificial Sequence; identical to SEQ ID NO: 23
  Description of Artificial Sequence: Synthetic polypeptide
  VL of XENP019858

SEQ ID NO: 1176 - protein, 5 aa, Artificial Sequence
  Description of Artificial Sequence: Synthetic peptide
  XENP019858 vhCDR1
SYTMH

SEQ ID NO: 1177 - protein, 17 aa, Artificial Sequence
  Description of Artificial Sequence: Synthetic peptide
  XENP019858 vhCDR2
FISYDGNNKYYADSVKG

SEQ ID NO: 1178 - protein, 9 aa, Artificial Sequence
  Description of Artificial Sequence: Synthetic peptide
  XENP019858 vhCDR3
TTWLGPFDY

SEQ ID NO: 1179 - protein, 12 aa, Artificial Sequence
  Description of Artificial Sequence: Synthetic peptide
  XENP019858 vlCDR1
RASQSVGSSYLA

SEQ ID NO: 1180 - protein, 7 aa, Artificial Sequence
  Description of Artificial Sequence: Synthetic peptide
  XENP019858 vlCDR2
GAFSRAT

SEQ ID NO: 1181 - protein, 9 aa, Artificial Sequence
  Description of Artificial Sequence: Synthetic peptide
  XENP019858 vlCDR3
QQYGSSPWT

SEQ ID NO: 1182 - protein, 246 aa, Artificial Sequence
  Description of Artificial Sequence: Synthetic polypeptide
  XENP019859 [CTLA-4]_H0.111_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGFLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1183 - protein, 118 aa, Artificial Sequence
  Description of Artificial Sequence: Synthetic polypeptide
  VH of XENP019859
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGFLGPFDYWGQGTLVTVSS

SEQ ID NO: 1184 - protein, 108 aa, Artificial Sequence; identical to SEQ ID NO: 23
  Description of Artificial Sequence: Synthetic polypeptide
  VL of XENP019859

SEQ ID NO: 1185 - protein, 5 aa, Artificial Sequence
  Description of Artificial Sequence: Synthetic peptide
  XENP019859 vhCDR1
SYTMH

SEQ ID NO: 1186 - protein, 17 aa, Artificial Sequence
  Description of Artificial Sequence: Synthetic peptide
  XENP019859 vhCDR2
FISYDGNNKYYADSVKG

SEQ ID NO: 1187 - protein, 9 aa, Artificial Sequence
  Description of Artificial Sequence: Synthetic peptide
  XENP019859 vhCDR3
TGFLGPFDY

SEQ ID NO: 1188 - protein, 12 aa, Artificial Sequence
  Description of Artificial Sequence: Synthetic peptide
  XENP019859 vlCDR1
RASQSVGSSYLA

SEQ ID NO: 1189 - protein, 7 aa, Artificial Sequence
  Description of Artificial Sequence: Synthetic peptide
  XENP019859 vlCDR2
GAFSRAT

SEQ ID NO: 1190 - protein, 9 aa, Artificial Sequence
  Description of Artificial Sequence: Synthetic peptide
  XENP019859 vlCDR3
QQYGSSPWT

SEQ ID NO: 1191 - protein, 246 aa, Artificial Sequence
  Description of Artificial Sequence: Synthetic polypeptide
  XENP019860 [CTLA-4]_H0.112_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGGLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1192 - protein, 118 aa, Artificial Sequence
  Description of Artificial Sequence: Synthetic polypeptide
  VH of XENP019860
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGGLGPFDYWGQGTLVTVSS

SEQ ID NO: 1193 - protein, 108 aa, Artificial Sequence; identical to SEQ ID NO: 23
  Description of Artificial Sequence: Synthetic polypeptide
  VL of XENP019860

SEQ ID NO: 1194 - protein, 5 aa, Artificial Sequence
  Description of Artificial Sequence: Synthetic peptide
  XENP019860 vhCDR1
SYTMH

SEQ ID NO: 1195 - protein, 17 aa, Artificial Sequence
  Description of Artificial Sequence: Synthetic peptide
  XENP019860 vhCDR2
FISYDGNNKYYADSVKG

SEQ ID NO: 1196 - protein, 9 aa, Artificial Sequence
  Description of Artificial Sequence: Synthetic peptide
  XENP019860 vhCDR3
TGGLGPFDY

SEQ ID NO: 1197 - protein, 12 aa, Artificial Sequence
  Description of Artificial Sequence: Synthetic peptide
  XENP019860 vlCDR1
RASQSVGSSYLA

SEQ ID NO: 1198 - protein, 7 aa, Artificial Sequence
  Description of Artificial Sequence: Synthetic peptide
  XENP019860 vlCDR2
GAFSRAT

SEQ ID NO: 1199 - protein, 9 aa, Artificial Sequence
  Description of Artificial Sequence: Synthetic peptide
  XENP019860 vlCDR3
QQYGSSPWT

SEQ ID NO: 1200 - protein, 246 aa, Artificial Sequence
  Description of Artificial Sequence: Synthetic polypeptide
  XENP019861 [CTLA-4]_H0.113_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGHLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1201 - protein, 118 aa, Artificial Sequence
  Description of Artificial Sequence: Synthetic polypeptide
  VH of XENP019861
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGHLGPFDYWGQGTLVTVSS

SEQ ID NO: 1202 - protein, 108 aa, Artificial Sequence; identical to SEQ ID NO: 23
  Description of Artificial Sequence: Synthetic polypeptide
  VL of XENP019861

SEQ ID NO: 1203 - protein, 5 aa, Artificial Sequence
  Description of Artificial Sequence: Synthetic peptide
  XENP019861 vhCDR1
SYTMH

SEQ ID NO: 1204 - protein, 17 aa, Artificial Sequence
  Description of Artificial Sequence: Synthetic peptide
  XENP019861 vhCDR2
FISYDGNNKYYADSVKG

SEQ ID NO: 1205 - protein, 9 aa, Artificial Sequence
  Description of Artificial Sequence: Synthetic peptide
  XENP019861 vhCDR3
TGHLGPFDY

SEQ ID NO: 1206 - protein, 12 aa, Artificial Sequence
  Description of Artificial Sequence: Synthetic peptide
  XENP019861 vlCDR1
RASQSVGSSYLA

SEQ ID NO: 1207 - protein, 7 aa, Artificial Sequence
  Description of Artificial Sequence: Synthetic peptide
  XENP019861 vlCDR2
GAFSRAT

SEQ ID NO: 1208 - protein, 9 aa, Artificial Sequence
  Description of Artificial Sequence: Synthetic peptide
  XENP019861 vlCDR3
QQYGSSPWT

SEQ ID NO: 1209 - protein, 246 aa, Artificial Sequence
  Description of Artificial Sequence: Synthetic polypeptide
  XENP019862 [CTLA-4]_H0.114_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGLLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1210 - protein, 118 aa, Artificial Sequence
  Description of Artificial Sequence: Synthetic polypeptide
  VH of XENP019862
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGLLGPFDYWGQGTLVTVSS

SEQ ID NO: 1211 - protein, 108 aa, Artificial Sequence; identical to SEQ ID NO: 23
  Description of Artificial Sequence: Synthetic polypeptide
  VL of XENP019862

SEQ ID NO: 1212 - protein, 5 aa, Artificial Sequence
  Description of Artificial Sequence: Synthetic peptide
  XENP019862 vhCDR1
SYTMH

SEQ ID NO: 1213 - protein, 17 aa, Artificial Sequence
  Description of Artificial Sequence: Synthetic peptide
  XENP019862 vhCDR2
FISYDGNNKYYADSVKG

SEQ ID NO: 1214 - protein, 9 aa, Artificial Sequence
  Description of Artificial Sequence: Synthetic peptide
  XENP019862 vhCDR3
TGLLGPFDY

SEQ ID NO: 1215 - protein, 12 aa, Artificial Sequence
  Description of Artificial Sequence: Synthetic peptide
  XENP019862 vlCDR1
RASQSVGSSYLA

SEQ ID NO: 1216 - protein, 7 aa, Artificial Sequence
  Description of Artificial Sequence: Synthetic peptide
  XENP019862 vlCDR2
GAFSRAT

SEQ ID NO: 1217 - protein, 9 aa, Artificial Sequence
  Description of Artificial Sequence: Synthetic peptide
  XENP019862 vlCDR3
QQYGSSPWT

SEQ ID NO: 1218 - protein, 246 aa, Artificial Sequence
  Description of Artificial Sequence: Synthetic polypeptide
  XENP019863 [CTLA-4]_H0.115_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGYLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1219 - protein, 118 aa, Artificial Sequence
  Description of Artificial Sequence: Synthetic polypeptide
  VH of XENP019863
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGYLGPFDYWGQGTLVTVSS

SEQ ID NO: 1220 - protein, 108 aa, Artificial Sequence; identical to SEQ ID NO: 23
  Description of Artificial Sequence: Synthetic polypeptide
  VL of XENP019863

SEQ ID NO: 1221 - protein, 5 aa, Artificial Sequence
  Description of Artificial Sequence: Synthetic peptide
  XENP019863 vhCDR1
SYTMH

SEQ ID NO: 1222 - protein, 17 aa, Artificial Sequence
  Description of Artificial Sequence: Synthetic peptide
  XENP019863 vhCDR2
FISYDGNNKYYADSVKG

SEQ ID NO: 1223 - protein, 9 aa, Artificial Sequence
  Description of Artificial Sequence: Synthetic peptide
  XENP019863 vhCDR3
TGYLGPFDY

SEQ ID NO: 1224 - protein, 12 aa, Artificial Sequence
  Description of Artificial Sequence: Synthetic peptide
  XENP019863 vlCDR1
RASQSVGSSYLA

SEQ ID NO: 1225 - protein, 7 aa, Artificial Sequence
  Description of Artificial Sequence: Synthetic peptide
  XENP019863 vlCDR2
GAFSRAT

SEQ ID NO: 1226 - protein, 9 aa, Artificial Sequence
  Description of Artificial Sequence: Synthetic peptide
  XENP019863 vlCDR3
QQYGSSPWT

SEQ ID NO: 1227 - protein, 246 aa, Artificial Sequence
  Description of Artificial Sequence: Synthetic polypeptide
  XENP019864 [CTLA-4]_H0.116_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWDGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1228 - protein, 118 aa, Artificial Sequence
  Description of Artificial Sequence: Synthetic polypeptide
  VH of XENP019864
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWDGPFDYWGQGTLVTVSS

SEQ ID NO: 1229 - protein, 108 aa, Artificial Sequence; identical to SEQ ID NO: 23
  Description of Artificial Sequence: Synthetic polypeptide
  VL of XENP019864

SEQ ID NO: 1230 - protein, 5 aa, Artificial Sequence
  Description of Artificial Sequence: Synthetic peptide
  XENP019864 vhCDR1
SYTMH

SEQ ID NO: 1231 - protein, 17 aa, Artificial Sequence
  Description of Artificial Sequence: Synthetic peptide
  XENP019864 vhCDR2
FISYDGNNKYYADSVKG

SEQ ID NO: 1232 - protein, 9 aa, Artificial Sequence
  Description of Artificial Sequence: Synthetic peptide
  XENP019864 vhCDR3
TGWDGPFDY

SEQ ID NO: 1233 - protein, 12 aa, Artificial Sequence
  Description of Artificial Sequence: Synthetic peptide
  XENP019864 vlCDR1
RASQSVGSSYLA

SEQ ID NO: 1234 - protein, 7 aa, Artificial Sequence
  Description of Artificial Sequence: Synthetic peptide
  XENP019864 vlCDR2
GAFSRAT

SEQ ID NO: 1235 - protein, 9 aa, Artificial Sequence
  Description of Artificial Sequence: Synthetic peptide
  XENP019864 vlCDR3
QQYGSSPWT

SEQ ID NO: 1236 - protein, 246 aa, Artificial Sequence
  Description of Artificial Sequence: Synthetic polypeptide
  XENP019865 [CTLA-4]_H0.117_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWIGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1237 - protein, 118 aa, Artificial Sequence
  Description of Artificial Sequence: Synthetic polypeptide
  VH of XENP019865
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWIGPFDYWGQGTLVTVSS

SEQ ID NO: 1238 - protein, 108 aa, Artificial Sequence; identical to SEQ ID NO: 23
  Description of Artificial Sequence: Synthetic polypeptide
  VL of XENP019865

SEQ ID NO: 1239 - protein, 5 aa, Artificial Sequence
  Description of Artificial Sequence: Synthetic peptide
  XENP019865 vhCDR1
SYTMH

SEQ ID NO: 1240 - protein, 17 aa, Artificial Sequence
  Description of Artificial Sequence: Synthetic peptide
  XENP019865 vhCDR2
FISYDGNNKYYADSVKG

SEQ ID NO: 1241 - protein, 9 aa, Artificial Sequence
  Description of Artificial Sequence: Synthetic peptide
  XENP019865 vhCDR3
TGWIGPFDY

SEQ ID NO: 1242 - protein, 12 aa, Artificial Sequence
  Description of Artificial Sequence: Synthetic peptide
  XENP019865 vlCDR1
RASQSVGSSYLA

SEQ ID NO: 1243 - protein, 7 aa, Artificial Sequence
  Description of Artificial Sequence: Synthetic peptide
  XENP019865 vlCDR2
GAFSRAT

SEQ ID NO: 1244 - protein, 9 aa, Artificial Sequence
  Description of Artificial Sequence: Synthetic peptide
  XENP019865 vlCDR3
QQYGSSPWT

SEQ ID NO: 1245 - protein, 246 aa, Artificial Sequence
  Description of Artificial Sequence: Synthetic polypeptide
  XENP019866 [CTLA-4]_H0.118_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWVGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1246 - protein, 118 aa, Artificial Sequence
  Description of Artificial Sequence: Synthetic polypeptide
  VH of XENP019866
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWVGPFDYWGQGTLVTVSS

SEQ ID NO: 1247 - protein, 108 aa, Artificial Sequence; identical to SEQ ID NO: 23
  Description of Artificial Sequence: Synthetic polypeptide
  VL of XENP019866

SEQ ID NO: 1248 - protein, 5 aa, Artificial Sequence
  Description of Artificial Sequence: Synthetic peptide
  XENP019866 vhCDR1
SYTMH

SEQ ID NO: 1249 - protein, 17 aa, Artificial Sequence
  Description of Artificial Sequence: Synthetic peptide
  XENP019866 vhCDR2
FISYDGNNKYYADSVKG

SEQ ID NO: 1250 - protein, 9 aa, Artificial Sequence
  Description of Artificial Sequence: Synthetic peptide
  XENP019866 vhCDR3
TGWVGPFDY

SEQ ID NO: 1251 - protein, 12 aa, Artificial Sequence
  Description of Artificial Sequence: Synthetic peptide
  XENP019866 vlCDR1
RASQSVGSSYLA

SEQ ID NO: 1252 - protein, 7 aa, Artificial Sequence
  Description of Artificial Sequence: Synthetic peptide
  XENP019866 vlCDR2
GAFSRAT

SEQ ID NO: 1253 - protein, 9 aa, Artificial Sequence
  Description of Artificial Sequence: Synthetic peptide
  XENP019866 vlCDR3
QQYGSSPWT

SEQ ID NO: 1254 - protein, 246 aa, Artificial Sequence
  Description of Artificial Sequence: Synthetic polypeptide
  XENP019867 [CTLA-4]_H0.119_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLAPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1255 - protein, 118 aa, Artificial Sequence
  Description of Artificial Sequence: Synthetic polypeptide
  VH of XENP019867
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLAPFDYWGQGTLVTVSS

SEQ ID NO: 1256 - protein, 108 aa, Artificial Sequence; identical to SEQ ID NO: 23
  Description of Artificial Sequence: Synthetic polypeptide
  VL of XENP019867

SEQ ID NO: 1257 - protein, 5 aa, Artificial Sequence
  Description of Artificial Sequence: Synthetic peptide
  XENP019867 vhCDR1
SYTMH

SEQ ID NO: 1258 - protein, 17 aa, Artificial Sequence
  Description of Artificial Sequence: Synthetic peptide
  XENP019867 vhCDR2
FISYDGNNKYYADSVKG

SEQ ID NO: 1259 - protein, 9 aa, Artificial Sequence
  Description of Artificial Sequence: Synthetic peptide
  XENP019867 vhCDR3
TGWLAPFDY

SEQ ID NO: 1260 - protein, 12 aa, Artificial Sequence
  Description of Artificial Sequence: Synthetic peptide
  XENP019867 vlCDR1
RASQSVGSSYLA

SEQ ID NO: 1261 - protein, 7 aa, Artificial Sequence
  Description of Artificial Sequence: Synthetic peptide
  XENP019867 vlCDR2
GAFSRAT

SEQ ID NO: 1262 - protein, 9 aa, Artificial Sequence
  Description of Artificial Sequence: Synthetic peptide
  XENP019867 vlCDR3
QQYGSSPWT

SEQ ID NO: 1263 - protein, 246 aa, Artificial Sequence
  Description of Artificial Sequence: Synthetic polypeptide
  XENP019868 [CTLA-4]_H0.120_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLSPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1264 - protein, 118 aa, Artificial Sequence
  Description of Artificial Sequence: Synthetic polypeptide
  VH of XENP019868
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLSPFDYWGQGTLVTVSS

SEQ ID NO: 1265 - protein, 108 aa, Artificial Sequence; identical to SEQ ID NO: 23
  Description of Artificial Sequence: Synthetic polypeptide
  VL of XENP019868

SEQ ID NO: 1266 - protein, 5 aa, Artificial Sequence
  Description of Artificial Sequence: Synthetic peptide
  XENP019868 vhCDR1
SYTMH

SEQ ID NO: 1267 - protein, 17 aa, Artificial Sequence
  Description of Artificial Sequence: Synthetic peptide
  XENP019868 vhCDR2
FISYDGNNKYYADSVKG

SEQ ID NO: 1268 - protein, 9 aa, Artificial Sequence
  Description of Artificial Sequence: Synthetic peptide
  XENP019868 vhCDR3
TGWLSPFDY

SEQ ID NO: 1269 - protein, 12 aa, Artificial Sequence
  Description of Artificial Sequence: Synthetic peptide
  XENP019868 vlCDR1
RASQSVGSSYLA

SEQ ID NO: 1270 - protein, 7 aa, Artificial Sequence
  Description of Artificial Sequence: Synthetic peptide
  XENP019868 vlCDR2
GAFSRAT

SEQ ID NO: 1271 - protein, 9 aa, Artificial Sequence
  Description of Artificial Sequence: Synthetic peptide
  XENP019868 vlCDR3
QQYGSSPWT

SEQ ID NO: 1272 - protein, 246 aa, Artificial Sequence
  Description of Artificial Sequence: Synthetic polypeptide
  XENP019869 [CTLA-4]_H0.121_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLTPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1273 - protein, 118 aa, Artificial Sequence
  Description of Artificial Sequence: Synthetic polypeptide
  VH of XENP019869
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLTPFDYWGQGTLVTVSS

SEQ ID NO: 1274 - protein, 108 aa, Artificial Sequence; identical to SEQ ID NO: 23
  Description of Artificial Sequence: Synthetic polypeptide
  VL of XENP019869

SEQ ID NO: 1275 - protein, 5 aa, Artificial Sequence
  Description of Artificial Sequence: Synthetic peptide
  XENP019869 vhCDR1
SYTMH

SEQ ID NO: 1276 - protein, 17 aa, Artificial Sequence
  Description of Artificial Sequence: Synthetic peptide
  XENP019869 vhCDR2
FISYDGNNKYYADSVKG

SEQ ID NO: 1277 - protein, 9 aa, Artificial Sequence
  Description of Artificial Sequence: Synthetic peptide
  XENP019869 vhCDR3
TGWLTPFDY

SEQ ID NO: 1278 - protein, 12 aa, Artificial Sequence
  Description of Artificial Sequence: Synthetic peptide
  XENP019869 vlCDR1
RASQSVGSSYLA

SEQ ID NO: 1279 - protein, 7 aa, Artificial Sequence
  Description of Artificial Sequence: Synthetic peptide
  XENP019869 vlCDR2
GAFSRAT

SEQ ID NO: 1280 - protein, 9 aa, Artificial Sequence
  Description of Artificial Sequence: Synthetic peptide
  XENP019869 vlCDR3
QQYGSSPWT

SEQ ID NO: 1281 - protein, 246 aa, Artificial Sequence
  Description of Artificial Sequence: Synthetic polypeptide
  XENP019870 [CTLA-4]_H0.122_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPLDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1282 - protein, 118 aa, Artificial Sequence
  Description of Artificial Sequence: Synthetic polypeptide
  VH of XENP019870
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPLDYWGQGTLVTVSS

SEQ ID NO: 1283 - protein, 108 aa, Artificial Sequence; identical to SEQ ID NO: 23
  Description of Artificial Sequence: Synthetic polypeptide
  VL of XENP019870

SEQ ID NO: 1284 - protein, 5 aa, Artificial Sequence
  Description of Artificial Sequence: Synthetic peptide
  XENP019870 vhCDR1
SYTMH

SEQ ID NO: 1285 - protein, 17 aa, Artificial Sequence
  Description of Artificial Sequence: Synthetic peptide
  XENP019870 vhCDR2
FISYDGNNKYYADSVKG

SEQ ID NO: 1286 - protein, 9 aa, Artificial Sequence
  Description of Artificial Sequence: Synthetic peptide
  XENP019870 vhCDR3
TGWLGPLDY

SEQ ID NO: 1287 - protein, 12 aa, Artificial Sequence
  Description of Artificial Sequence: Synthetic peptide
  XENP019870 vlCDR1
RASQSVGSSYLA

SEQ ID NO: 1288 - protein, 7 aa, Artificial Sequence
  Description of Artificial Sequence: Synthetic peptide
  XENP019870 vlCDR2
GAFSRAT

SEQ ID NO: 1289 - protein, 9 aa, Artificial Sequence
  Description of Artificial Sequence: Synthetic peptide
  XENP019870 vlCDR3
QQYGSSPWT

SEQ ID NO: 1290 - protein, 246 aa, Artificial Sequence
  Description of Artificial Sequence: Synthetic polypeptide
  XENP019871 [CTLA-4]_H0.123_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPMDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1291 - protein, 118 aa, Artificial Sequence
  Description of Artificial Sequence: Synthetic polypeptide
  VH of XENP019871
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPMDYWGQGTLVTVSS

SEQ ID NO: 1292 - protein, 108 aa, Artificial Sequence; identical to SEQ ID NO: 23
  Description of Artificial Sequence: Synthetic polypeptide
  VL of XENP019871

SEQ ID NO: 1293 - protein, 5 aa, Artificial Sequence
  Description of Artificial Sequence: Synthetic peptide
  XENP019871 vhCDR1
SYTMH

SEQ ID NO: 1294 - protein, 17 aa, Artificial Sequence
  Description of Artificial Sequence: Synthetic peptide
  XENP019871 vhCDR2
FISYDGNNKYYADSVKG

SEQ ID NO: 1295 - protein, 9 aa, Artificial Sequence
  Description of Artificial Sequence: Synthetic peptide
  XENP019871 vhCDR3
TGWLGPMDY

SEQ ID NO: 1296 - protein, 12 aa, Artificial Sequence
  Description of Artificial Sequence: Synthetic peptide
  XENP019871 vlCDR1
RASQSVGSSYLA

SEQ ID NO: 1297 - protein, 7 aa, Artificial Sequence
  Description of Artificial Sequence: Synthetic peptide
  XENP019871 vlCDR2
GAFSRAT

SEQ ID NO: 1298 - protein, 9 aa, Artificial Sequence
  Description of Artificial Sequence: Synthetic peptide
  XENP019871 vlCDR3
QQYGSSPWT

SEQ ID NO: 1299 - protein, 246 aa, Artificial Sequence
  Description of Artificial Sequence: Synthetic polypeptide
  XENP019872 [CTLA-4]_H0.124_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFAYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1300 - protein, 118 aa, Artificial Sequence
  Description of Artificial Sequence: Synthetic polypeptide
  VH of XENP019872
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFAYWGQGTLVTVSS

SEQ ID NO: 1301 - protein, 108 aa, Artificial Sequence; identical to SEQ ID NO: 23
  Description of Artificial Sequence: Synthetic polypeptide
  VL of XENP019872

SEQ ID NO: 1302 - protein, 5 aa, Artificial Sequence
  Description of Artificial Sequence: Synthetic peptide
  XENP019872 vhCDR1
SYTMH

SEQ ID NO: 1303 - protein, 17 aa, Artificial Sequence
  Description of Artificial Sequence: Synthetic peptide
  XENP019872 vhCDR2
FISYDGNNKYYADSVKG

SEQ ID NO: 1304 - protein, 9 aa, Artificial Sequence
  Description of Artificial Sequence: Synthetic peptide
  XENP019872 vhCDR3
TGWLGPFAY

SEQ ID NO: 1305 - protein, 12 aa, Artificial Sequence
  Description of Artificial Sequence: Synthetic peptide
  XENP019872 vlCDR1
RASQSVGSSYLA

SEQ ID NO: 1306 - protein, 7 aa, Artificial Sequence
  Description of Artificial Sequence: Synthetic peptide
  XENP019872 vlCDR2
GAFSRAT

SEQ ID NO: 1307 - protein, 9 aa, Artificial Sequence
  Description of Artificial Sequence: Synthetic peptide
  XENP019872 vlCDR3
QQYGSSPWT

SEQ ID NO: 1308 - protein, 246 aa, Artificial Sequence
  Description of Artificial Sequence: Synthetic polypeptide
  XENP019873 [CTLA-4]_H0.125_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFEYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1309 - protein, 118 aa, Artificial Sequence
  Description of Artificial Sequence: Synthetic polypeptide
  VH of XENP019873
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFEYWGQGTLVTVSS

SEQ ID NO: 1310 - protein, 108 aa, Artificial Sequence; identical to SEQ ID NO: 23
  Description of Artificial Sequence: Synthetic polypeptide
  VL of XENP019873

SEQ ID NO: 1311 - protein, 5 aa, Artificial Sequence
  Description of Artificial Sequence: Synthetic peptide
  XENP019873 vhCDR1
SYTMH

SEQ ID NO: 1312 - protein, 17 aa, Artificial Sequence
  Description of Artificial Sequence: Synthetic peptide
  XENP019873 vhCDR2
FISYDGNNKYYADSVKG

SEQ ID NO: 1313 - protein, 9 aa, Artificial Sequence
  Description of Artificial Sequence: Synthetic peptide
  XENP019873 vhCDR3
TGWLGPFEY

SEQ ID NO: 1314 - protein, 12 aa, Artificial Sequence
  Description of Artificial Sequence: Synthetic peptide
  XENP019873 vlCDR1
RASQSVGSSYLA

SEQ ID NO: 1315 - protein, 7 aa, Artificial Sequence
  Description of Artificial Sequence: Synthetic peptide
  XENP019873 vlCDR2
GAFSRAT

SEQ ID NO: 1316 - protein, 9 aa, Artificial Sequence
  Description of Artificial Sequence: Synthetic peptide
  XENP019873 vlCDR3
QQYGSSPWT

SEQ ID NO: 1317 - protein, 246 aa, Artificial Sequence
  Description of Artificial Sequence: Synthetic polypeptide
  XENP019874 [CTLA-4]_H0.126_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFHYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1318 - protein, 118 aa, Artificial Sequence
  Description of Artificial Sequence: Synthetic polypeptide
  VH of XENP019874
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFHYWGQGTLVTVSS

SEQ ID NO: 1319 - protein, 108 aa, Artificial Sequence; identical to SEQ ID NO: 23
  Description of Artificial Sequence: Synthetic polypeptide
  VL of XENP019874

SEQ ID NO: 1320 - protein, 5 aa, Artificial Sequence
  Description of Artificial Sequence: Synthetic peptide
  XENP019874 vhCDR1
SYTMH

SEQ ID NO: 1321 - protein, 17 aa, Artificial Sequence
  Description of Artificial Sequence: Synthetic peptide
  XENP019874 vhCDR2
FISYDGNNKYYADSVKG

SEQ ID NO: 1322 - protein, 9 aa, Artificial Sequence
  Description of Artificial Sequence: Synthetic peptide
  XENP019874 vhCDR3
TGWLGPFHY

SEQ ID NO: 1323 - protein, 12 aa, Artificial Sequence
  Description of Artificial Sequence: Synthetic peptide
  XENP019874 vlCDR1
RASQSVGSSYLA

SEQ ID NO: 1324 - protein, 7 aa, Artificial Sequence
  Description of Artificial Sequence: Synthetic peptide
  XENP019874 vlCDR2
GAFSRAT

SEQ ID NO: 1325 - protein, 9 aa, Artificial Sequence
  Description of Artificial Sequence: Synthetic peptide
  XENP019874 vlCDR3
QQYGSSPWT

SEQ ID NO: 1326 - protein, 246 aa, Artificial Sequence
  Description of Artificial Sequence: Synthetic polypeptide
  XENP019875 [CTLA-4]_H0.127_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFNYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1327 - protein, 118 aa, Artificial Sequence
  Description of Artificial Sequence: Synthetic polypeptide
  VH of XENP019875
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFNYWGQGTLVTVSS

SEQ ID NO: 1328 - protein, 108 aa, Artificial Sequence; identical to SEQ ID NO: 23
  Description of Artificial Sequence: Synthetic polypeptide
  VL of XENP019875

SEQ ID NO: 1329 - protein, 5 aa, Artificial Sequence
  Description of Artificial Sequence: Synthetic peptide
  XENP019875 vhCDR1
SYTMH

SEQ ID NO: 1330 - protein, 17 aa, Artificial Sequence
  Description of Artificial Sequence: Synthetic peptide
  XENP019875 vhCDR2
FISYDGNNKYYADSVKG

SEQ ID NO: 1331 - protein, 9 aa, Artificial Sequence
  Description of Artificial Sequence: Synthetic peptide
  XENP019875 vhCDR3
TGWLGPFNY

SEQ ID NO: 1332 - protein, 12 aa, Artificial Sequence
  Description of Artificial Sequence: Synthetic peptide
  XENP019875 vlCDR1
RASQSVGSSYLA

SEQ ID NO: 1333 - protein, 7 aa, Artificial Sequence
  Description of Artificial Sequence: Synthetic peptide
  XENP019875 vlCDR2
GAFSRAT

SEQ ID NO: 1334 - protein, 9 aa, Artificial Sequence
  Description of Artificial Sequence: Synthetic peptide
  XENP019875 vlCDR3
QQYGSSPWT

SEQ ID NO: 1335 - protein, 246 aa, Artificial Sequence
  Description of Artificial Sequence: Synthetic polypeptide
  XENP019876 [CTLA-4]_H0.128_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFSYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1336 - protein, 118 aa, Artificial Sequence
  Description of Artificial Sequence: Synthetic polypeptide
  VH of XENP019876
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFSYWGQGTLVTVSS

SEQ ID NO: 1337 - protein, 108 aa, Artificial Sequence; identical to SEQ ID NO: 23
  Description of Artificial Sequence: Synthetic polypeptide
  VL of XENP019876

SEQ ID NO: 1338 - protein, 5 aa, Artificial Sequence
  Description of Artificial Sequence: Synthetic peptide
  XENP019876 vhCDR1
SYTMH

SEQ ID NO: 1339 - protein, 17 aa, Artificial Sequence
  Description of Artificial Sequence: Synthetic peptide
  XENP019876 vhCDR2
FISYDGNNKYYADSVKG

SEQ ID NO: 1340 - protein, 9 aa, Artificial Sequence
  Description of Artificial Sequence: Synthetic peptide
  XENP019876 vhCDR3
TGWLGPFSY

SEQ ID NO: 1341 - protein, 12 aa, Artificial Sequence
  Description of Artificial Sequence: Synthetic peptide
  XENP019876 vlCDR1
RASQSVGSSYLA

SEQ ID NO: 1342 - protein, 7 aa, Artificial Sequence
  Description of Artificial Sequence: Synthetic peptide
  XENP019876 vlCDR2
GAFSRAT

SEQ ID NO: 1343 - protein, 9 aa, Artificial Sequence
  Description of Artificial Sequence: Synthetic peptide
  XENP019876 vlCDR3
QQYGSSPWT

SEQ ID NO: 1344 - protein, 246 aa, Artificial Sequence
  Description of Artificial Sequence: Synthetic polypeptide
  XENP019877 [CTLA-4]_H0.129_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFQYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1345 - protein, 118 aa, Artificial Sequence
  Description of Artificial Sequence: Synthetic polypeptide
  VH of XENP019877
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFQYWGQGTLVTVSS

SEQ ID NO: 1346 - protein, 108 aa, Artificial Sequence; identical to SEQ ID NO: 23
  Description of Artificial Sequence: Synthetic polypeptide
  VL of XENP019877

SEQ ID NO: 1347 - protein, 5 aa, Artificial Sequence
  Description of Artificial Sequence: Synthetic peptide
  XENP019877 vhCDR1
SYTMH

SEQ ID NO: 1348 - protein, 17 aa, Artificial Sequence
  Description of Artificial Sequence: Synthetic peptide
  XENP019877 vhCDR2
FISYDGNNKYYADSVKG

SEQ ID NO: 1349 - protein, 9 aa, Artificial Sequence
  Description of Artificial Sequence: Synthetic peptide
  XENP019877 vhCDR3
TGWLGPFQY

SEQ ID NO: 1350 - protein, 12 aa, Artificial Sequence
  Description of Artificial Sequence: Synthetic peptide
  XENP019877 vlCDR1
RASQSVGSSYLA

SEQ ID NO: 1351 - protein, 7 aa, Artificial Sequence
  Description of Artificial Sequence: Synthetic peptide
  XENP019877 vlCDR2
GAFSRAT

SEQ ID NO: 1352 - protein, 9 aa, Artificial Sequence
  Description of Artificial Sequence: Synthetic peptide
  XENP019877 vlCDR3
QQYGSSPWT

SEQ ID NO: 1353 - protein, 246 aa, Artificial Sequence
  Description of Artificial Sequence: Synthetic polypeptide
  XENP019878 [CTLA-4]_H0.130_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDHWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1354 - protein, 118 aa, Artificial Sequence
  Description of Artificial Sequence: Synthetic polypeptide
  VH of XENP019878
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDHWGQGTLVTVSS

SEQ ID NO: 1355 - protein, 108 aa, Artificial Sequence; identical to SEQ ID NO: 23
  Description of Artificial Sequence: Synthetic polypeptide
  VL of XENP019878

SEQ ID NO: 1356 - protein, 5 aa, Artificial Sequence
  Description of Artificial Sequence: Synthetic peptide
  XENP019878 vhCDR1
SYTMH

SEQ ID NO: 1357 - protein, 17 aa, Artificial Sequence
  Description of Artificial Sequence: Synthetic peptide
  XENP019878 vhCDR2
FISYDGNNKYYADSVKG

SEQ ID NO: 1358 - protein, 9 aa, Artificial Sequence
  Description of Artificial Sequence: Synthetic peptide
  XENP019878 vhCDR3
TGWLGPFDH

SEQ ID NO: 1359 - protein, 12 aa, Artificial Sequence
  Description of Artificial Sequence: Synthetic peptide
  XENP019878 vlCDR1
RASQSVGSSYLA

SEQ ID NO: 1360 - protein, 7 aa, Artificial Sequence
  Description of Artificial Sequence: Synthetic peptide
  XENP019878 vlCDR2
GAFSRAT

SEQ ID NO: 1361 - protein, 9 aa, Artificial Sequence
  Description of Artificial Sequence: Synthetic peptide
  XENP019878 vlCDR3
QQYGSSPWT

SEQ ID NO: 1362 - protein, 246 aa, Artificial Sequence
  Description of Artificial Sequence: Synthetic polypeptide
  XENP019879 [CTLA-4]_H0.131_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDLWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1363 - protein, 118 aa, Artificial Sequence
  Description of Artificial Sequence: Synthetic polypeptide
  VH of XENP019879
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDLWGQGTLVTVSS

SEQ ID NO: 1364 - protein, 108 aa, Artificial Sequence; identical to SEQ ID NO: 23
  Description of Artificial Sequence: Synthetic polypeptide
  VL of XENP019879

SEQ ID NO: 1365 - protein, 5 aa, Artificial Sequence
  Description of Artificial Sequence: Synthetic peptide
  XENP019879 vhCDR1
SYTMH

SEQ ID NO: 1366 - protein, 17 aa, Artificial Sequence
  Description of Artificial Sequence: Synthetic peptide
  XENP019879 vhCDR2
FISYDGNNKYYADSVKG

SEQ ID NO: 1367 - protein, 9 aa, Artificial Sequence
  Description of Artificial Sequence: Synthetic peptide
  XENP019879 vhCDR3
TGWLGPFDL

SEQ ID NO: 1368 - protein, 12 aa, Artificial Sequence
  Description of Artificial Sequence: Synthetic peptide
  XENP019879 vlCDR1
RASQSVGSSYLA

SEQ ID NO: 1369 - protein, 7 aa, Artificial Sequence
  Description of Artificial Sequence: Synthetic peptide
  XENP019879 vlCDR2
GAFSRAT

SEQ ID NO: 1370 - protein, 9 aa, Artificial Sequence
  Description of Artificial Sequence: Synthetic peptide
  XENP019879 vlCDR3
QQYGSSPWT

SEQ ID NO: 1371 - protein, 246 aa, Artificial Sequence
  Description of Artificial Sequence: Synthetic polypeptide
  XENP019880 [CTLA-4]_H0.132_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDSWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1372 - protein, 118 aa, Artificial Sequence
  Description of Artificial Sequence: Synthetic polypeptide
  VH of XENP019880
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDSWGQGTLVTVSS

SEQ ID NO: 1373 - protein, 108 aa, Artificial Sequence; identical to SEQ ID NO: 23
  Description of Artificial Sequence: Synthetic polypeptide
  VL of XENP019880

SEQ ID NO: 1374 - protein, 5 aa, Artificial Sequence
  Description of Artificial Sequence: Synthetic peptide
  XENP019880 vhCDR1
SYTMH

SEQ ID NO: 1375 - protein, 17 aa, Artificial Sequence
  Description of Artificial Sequence: Synthetic peptide
  XENP019880 vhCDR2
FISYDGNNKYYADSVKG

SEQ ID NO: 1376 - protein, 9 aa, Artificial Sequence
  Description of Artificial Sequence: Synthetic peptide
  XENP019880 vhCDR3
TGWLGPFDS

SEQ ID NO: 1377 - protein, 12 aa, Artificial Sequence
  Description of Artificial Sequence: Synthetic peptide
  XENP019880 vlCDR1
RASQSVGSSYLA

SEQ ID NO: 1378 - protein, 7 aa, Artificial Sequence
  Description of Artificial Sequence: Synthetic peptide
  XENP019880 vlCDR2
GAFSRAT

SEQ ID NO: 1379 - protein, 9 aa, Artificial Sequence
  Description of Artificial Sequence: Synthetic peptide
  XENP019880 vlCDR3
QQYGSSPWT

SEQ ID NO: 1380 - protein, 246 aa, Artificial Sequence
  Description of Artificial Sequence: Synthetic polypeptide
  XENP019881 [CTLA-4]_H0.133_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDVWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1381 - protein, 118 aa, Artificial Sequence
  Description of Artificial Sequence: Synthetic polypeptide
  VH of XENP019881
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDVWGQGTLVTVSS

SEQ ID NO: 1382 - protein, 108 aa, Artificial Sequence; identical to SEQ ID NO: 23
  Description of Artificial Sequence: Synthetic polypeptide
  VL of XENP019881

SEQ ID NO: 1383 - protein, 5 aa, Artificial Sequence
  Description of Artificial Sequence: Synthetic peptide
  XENP019881 vhCDR1
SYTMH

SEQ ID NO: 1384 - protein, 17 aa, Artificial Sequence
  Description of Artificial Sequence: Synthetic peptide
  XENP019881 vhCDR2
FISYDGNNKYYADSVKG

SEQ ID NO: 1385 - protein, 9 aa, Artificial Sequence
  Description of Artificial Sequence: Synthetic peptide
  XENP019881 vhCDR3
TGWLGPFDV

SEQ ID NO: 1386 - protein, 12 aa, Artificial Sequence
  Description of Artificial Sequence: Synthetic peptide
  XENP019881 vlCDR1
RASQSVGSSYLA

SEQ ID NO: 1387 - protein, 7 aa, Artificial Sequence
  Description of Artificial Sequence: Synthetic peptide
  XENP019881 vlCDR2
GAFSRAT

SEQ ID NO: 1388 - protein, 9 aa, Artificial Sequence
  Description of Artificial Sequence: Synthetic peptide
  XENP019881 vlCDR3
QQYGSSPWT

SEQ ID NO: 1389 - protein, 246 aa, Artificial Sequence
  Description of Artificial Sequence: Synthetic polypeptide
  XENP019882 [CTLA-4]_H0.134_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGRGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1390 - protein, 118 aa, Artificial Sequence; identical to SEQ ID NO: 67
  Description of Artificial Sequence: Synthetic polypeptide
  VH of XENP019882

SEQ ID NO: 1391 - protein, 108 aa, Artificial Sequence; identical to SEQ ID NO: 23
  Description of Artificial Sequence: Synthetic polypeptide
  VL of XENP019882

SEQ ID NO: 1392 - protein, 5 aa, Artificial Sequence
  Description of Artificial Sequence: Synthetic peptide
  XENP019882 vhCDR1
SYTMH

SEQ ID NO: 1393 - protein, 17 aa, Artificial Sequence
  Description of Artificial Sequence: Synthetic peptide
  XENP019882 vhCDR2
FISYDGNNKYYADSVKG

SEQ ID NO: 1394 - protein, 9 aa, Artificial Sequence
  Description of Artificial Sequence: Synthetic peptide
  XENP019882 vhCDR3
TGWLGPFDY

SEQ ID NO: 1395 - protein, 12 aa, Artificial Sequence
  Description of Artificial Sequence: Synthetic peptide
  XENP019882 vlCDR1
RASQSVGSSYLA

SEQ ID NO: 1396 - protein, 7 aa, Artificial Sequence
  Description of Artificial Sequence: Synthetic peptide
  XENP019882 vlCDR2
GAFSRAT

SEQ ID NO: 1397 - protein, 9 aa, Artificial Sequence
  Description of Artificial Sequence: Synthetic peptide
  XENP019882 vlCDR3
QQYGSSPWT

SEQ ID NO: 1398 - protein, 246 aa, Artificial Sequence
  Description of Artificial Sequence: Synthetic polypeptide
  XENP019883 [CTLA-4]_H0.135_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTMVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1399 - protein, 118 aa, Artificial Sequence
  Description of Artificial Sequence: Synthetic polypeptide
  VH of XENP019883
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTMVTVSS

SEQ ID NO: 1400 - protein, 108 aa, Artificial Sequence; identical to SEQ ID NO: 23
  Description of Artificial Sequence: Synthetic polypeptide
  VL of XENP019883

SEQ ID NO: 1401 - protein, 5 aa, Artificial Sequence
  Description of Artificial Sequence: Synthetic peptide
  XENP019883 vhCDR1
SYTMH

SEQ ID NO: 1402 - protein, 17 aa, Artificial Sequence
  Description of Artificial Sequence: Synthetic peptide
  XENP019883 vhCDR2
FISYDGNNKYYADSVKG

SEQ ID NO: 1403 - protein, 9 aa, Artificial Sequence
  Description of Artificial Sequence: Synthetic peptide
  XENP019883 vhCDR3
TGWLGPFDY

SEQ ID NO: 1404 - protein, 12 aa, Artificial Sequence
  Description of Artificial Sequence: Synthetic peptide
  XENP019883 vlCDR1
RASQSVGSSYLA

SEQ ID NO: 1405 - protein, 7 aa, Artificial Sequence
  Description of Artificial Sequence: Synthetic peptide
  XENP019883 vlCDR2
GAFSRAT

SEQ ID NO: 1406 - protein, 9 aa, Artificial Sequence
  Description of Artificial Sequence: Synthetic peptide
  XENP019883 vlCDR3
QQYGSSPWT

SEQ ID NO: 1407 - protein, 246 aa, Artificial Sequence
  Description of Artificial Sequence: Synthetic polypeptide
  XENP019884 [CTLA-4]_H0.136_L0_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTTVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1408 - protein, 118 aa, Artificial Sequence
  Description of Artificial Sequence: Synthetic polypeptide
  VH of XENP019884
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTTVTVSS

SEQ ID NO: 1409 - protein, 108 aa, Artificial Sequence; identical to SEQ ID NO: 23
  Description of Artificial Sequence: Synthetic polypeptide
  VL of XENP019884

SEQ ID NO: 1410 - protein, 5 aa, Artificial Sequence
  Description of Artificial Sequence: Synthetic peptide
  XENP019884 vhCDR1
SYTMH

SEQ ID NO: 1411 - protein, 17 aa, Artificial Sequence
  Description of Artificial Sequence: Synthetic peptide
  XENP019884 vhCDR2
FISYDGNNKYYADSVKG

SEQ ID NO: 1412 - protein, 9 aa, Artificial Sequence
  Description of Artificial Sequence: Synthetic peptide
  XENP019884 vhCDR3
TGWLGPFDY

SEQ ID NO: 1413 - protein, 12 aa, Artificial Sequence
  Description of Artificial Sequence: Synthetic peptide
  XENP019884 vlCDR1
RASQSVGSSYLA

SEQ ID NO: 1414 - protein, 7 aa, Artificial Sequence
  Description of Artificial Sequence: Synthetic peptide
  XENP019884 vlCDR2
GAFSRAT

SEQ ID NO: 1415 - protein, 9 aa, Artificial Sequence
  Description of Artificial Sequence: Synthetic peptide
  XENP019884 vlCDR3
QQYGSSPWT

SEQ ID NO: 1416 - protein, 246 aa, Artificial Sequence
  Description of Artificial Sequence: Synthetic polypeptide
  XENP019885 [CTLA-4]_H0_L0.1_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSAIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1417 - protein, 118 aa, Artificial Sequence; identical to SEQ ID NO: 22
  Description of Artificial Sequence: Synthetic polypeptide
  VH of XENP019885

SEQ ID NO: 1418 - protein, 108 aa, Artificial Sequence
  Description of Artificial Sequence: Synthetic polypeptide
  VL of XENP019885
AIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1419 - protein, 5 aa, Artificial Sequence
  Description of Artificial Sequence: Synthetic peptide
  XENP019885 vhCDR1
SYTMH

SEQ ID NO: 1420 - protein, 17 aa, Artificial Sequence
  Description of Artificial Sequence: Synthetic peptide
  XENP019885 vhCDR2
FISYDGNNKYYADSVKG

SEQ ID NO: 1421 - protein, 9 aa, Artificial Sequence
  Description of Artificial Sequence: Synthetic peptide
  XENP019885 vhCDR3
TGWLGPFDY

SEQ ID NO: 1422 - protein, 12 aa, Artificial Sequence
  Description of Artificial Sequence: Synthetic peptide
  XENP019885 vlCDR1
RASQSVGSSYLA

SEQ ID NO: 1423 - protein, 7 aa, Artificial Sequence
  Description of Artificial Sequence: Synthetic peptide
  XENP019885 vlCDR2
GAFSRAT

SEQ ID NO: 1424 - protein, 9 aa, Artificial Sequence
  Description of Artificial Sequence: Synthetic peptide
  XENP019885 vlCDR3
QQYGSSPWT

SEQ ID NO: 1425 - protein, 246 aa, Artificial Sequence
  Description of Artificial Sequence: Synthetic polypeptide
  XENP019886 [CTLA-4]_H0_L0.2_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSDIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1426 - protein, 118 aa, Artificial Sequence; identical to SEQ ID NO: 22
  Description of Artificial Sequence: Synthetic polypeptide
  VH of XENP019886

SEQ ID NO: 1427 - protein, 108 aa, Artificial Sequence
  Description of Artificial Sequence: Synthetic polypeptide
  VL of XENP019886
DIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1428 - protein, 5 aa, Artificial Sequence
  Description of Artificial Sequence: Synthetic peptide
  XENP019886 vhCDR1
SYTMH

SEQ ID NO: 1429 - protein, 17 aa, Artificial Sequence
  Description of Artificial Sequence: Synthetic peptide
  XENP019886 vhCDR2
FISYDGNNKYYADSVKG

SEQ ID NO: 1430 - protein, 9 aa, Artificial Sequence
  Description of Artificial Sequence: Synthetic peptide
  XENP019886 vhCDR3
TGWLGPFDY

SEQ ID NO: 1431 - protein, 12 aa, Artificial Sequence
  Description of Artificial Sequence: Synthetic peptide
  XENP019886 vlCDR1
RASQSVGSSYLA

SEQ ID NO: 1432 - protein, 7 aa, Artificial Sequence
  Description of Artificial Sequence: Synthetic peptide
  XENP019886 vlCDR2
GAFSRAT

SEQ ID NO: 1433 - protein, 9 aa, Artificial Sequence
  Description of Artificial Sequence: Synthetic peptide
  XENP019886 vlCDR3
QQYGSSPWT

SEQ ID NO: 1434 - protein, 246 aa, Artificial Sequence
  Description of Artificial Sequence: Synthetic polypeptide
  XENP019887 [CTLA-4]_H0_L0.3_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSQIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1435 - protein, 118 aa, Artificial Sequence; identical to SEQ ID NO: 22
  Description of Artificial Sequence: Synthetic polypeptide
  VH of XENP019887

SEQ ID NO: 1436 - protein, 108 aa, Artificial Sequence
  Description of Artificial Sequence: Synthetic polypeptide
  VL of XENP019887
QIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1437 - protein, 5 aa, Artificial Sequence
  Description of Artificial Sequence: Synthetic peptide
  XENP019887 vhCDR1
SYTMH

SEQ ID NO: 1438 - protein, 17 aa, Artificial Sequence
  Description of Artificial Sequence: Synthetic peptide
  XENP019887 vhCDR2
FISYDGNNKYYADSVKG

SEQ ID NO: 1439 - protein, 9 aa, Artificial Sequence
  Description of Artificial Sequence: Synthetic peptide
  XENP019887 vhCDR3
TGWLGPFDY

SEQ ID NO: 1440 - protein, 12 aa, Artificial Sequence
  Description of Artificial Sequence: Synthetic peptide
  XENP019887 vlCDR1
RASQSVGSSYLA

SEQ ID NO: 1441 - protein, 7 aa, Artificial Sequence
  Description of Artificial Sequence: Synthetic peptide
  XENP019887 vlCDR2
GAFSRAT

SEQ ID NO: 1442 - protein, 9 aa, Artificial Sequence
  Description of Artificial Sequence: Synthetic peptide
  XENP019887 vlCDR3
QQYGSSPWT

SEQ ID NO: 1443 - protein, 246 aa, Artificial Sequence
  Description of Artificial Sequence: Synthetic polypeptide
  XENP019888 [CTLA-4]_H0_L0.4_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSRIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1444 - protein, 118 aa, Artificial Sequence; identical to SEQ ID NO: 22
  Description of Artificial Sequence: Synthetic polypeptide
  VH of XENP019888

SEQ ID NO: 1445 - protein, 108 aa, Artificial Sequence
  Description of Artificial Sequence: Synthetic polypeptide
  VL of XENP019888
RIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1446 - protein, 5 aa, Artificial Sequence
  Description of Artificial Sequence: Synthetic peptide
  XENP019888 vhCDR1
SYTMH

SEQ ID NO: 1447 - protein, 17 aa, Artificial Sequence
  Description of Artificial Sequence: Synthetic peptide
  XENP019888 vhCDR2
FISYDGNNKYYADSVKG

SEQ ID NO: 1448 - protein, 9 aa, Artificial Sequence
  Description of Artificial Sequence: Synthetic peptide
  XENP019888 vhCDR3
TGWLGPFDY

SEQ ID NO: 1449 - protein, 12 aa, Artificial Sequence
  Description of Artificial Sequence: Synthetic peptide
  XENP019888 vlCDR1
RASQSVGSSYLA

SEQ ID NO: 1450 - protein, 7 aa, Artificial Sequence
  Description of Artificial Sequence: Synthetic peptide
  XENP019888 vlCDR2
GAFSRAT

SEQ ID NO: 1451 - protein, 9 aa, Artificial Sequence
  Description of Artificial Sequence: Synthetic peptide
  XENP019888 vlCDR3
QQYGSSPWT

SEQ ID NO: 1452 - protein, 246 aa, Artificial Sequence
  Description of Artificial Sequence: Synthetic polypeptide
  XENP019889 [CTLA-4]_H0_L0.5_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIRLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1453 - protein, 118 aa, Artificial Sequence; identical to SEQ ID NO: 22
  Description of Artificial Sequence: Synthetic polypeptide
  VH of XENP019889

SEQ ID NO: 1454 - protein, 108 aa, Artificial Sequence
  Description of Artificial Sequence: Synthetic polypeptide
  VL of XENP019889
EIRLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1455 - protein, 5 aa, Artificial Sequence
  Description of Artificial Sequence: Synthetic peptide
  XENP019889 vhCDR1
SYTMH

SEQ ID NO: 1456 - protein, 17 aa, Artificial Sequence
  Description of Artificial Sequence: Synthetic peptide
  XENP019889 vhCDR2
FISYDGNNKYYADSVKG

SEQ ID NO: 1457 - protein, 9 aa, Artificial Sequence
  Description of Artificial Sequence: Synthetic peptide
  XENP019889 vhCDR3
TGWLGPFDY

SEQ ID NO: 1458 - protein, 12 aa, Artificial Sequence
  Description of Artificial Sequence: Synthetic peptide
  XENP019889 vlCDR1
RASQSVGSSYLA

SEQ ID NO: 1459 - protein, 7 aa, Artificial Sequence
  Description of Artificial Sequence: Synthetic peptide
  XENP019889 vlCDR2
GAFSRAT

SEQ ID NO: 1460 - protein, 9 aa, Artificial Sequence
  Description of Artificial Sequence: Synthetic peptide
  XENP019889 vlCDR3
QQYGSSPWT

SEQ ID NO: 1461 - protein, 246 aa, Artificial Sequence
  Description of Artificial Sequence: Synthetic polypeptide
  XENP019890 [CTLA-4]_H0_L0.6_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIRLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGEGTKVEIK

SEQ ID NO: 1462 - protein, 118 aa, Artificial Sequence; identical to SEQ ID NO: 22
  Description of Artificial Sequence: Synthetic polypeptide
  VH of XENP019890

SEQ ID NO: 1463 - protein, 108 aa, Artificial Sequence
  Description of Artificial Sequence: Synthetic polypeptide
  VL of XENP019890
EIRLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGEGTKVEIK

SEQ ID NO: 1464 - protein, 5 aa, Artificial Sequence
  Description of Artificial Sequence: Synthetic peptide
  XENP019890 vhCDR1
SYTMH

SEQ ID NO: 1465 - protein, 17 aa, Artificial Sequence
  Description of Artificial Sequence: Synthetic peptide
  XENP019890 vhCDR2
FISYDGNNKYYADSVKG

SEQ ID NO: 1466 - protein, 9 aa, Artificial Sequence
  Description of Artificial Sequence: Synthetic peptide
  XENP019890 vhCDR3
TGWLGPFDY

SEQ ID NO: 1467 - protein, 12 aa, Artificial Sequence
  Description of Artificial Sequence: Synthetic peptide
  XENP019890 vlCDR1
RASQSVGSSYLA

SEQ ID NO: 1468 - protein, 7 aa, Artificial Sequence
  Description of Artificial Sequence: Synthetic peptide
  XENP019890 vlCDR2
GAFSRAT

SEQ ID NO: 1469 - protein, 9 aa, Artificial Sequence
  Description of Artificial Sequence: Synthetic peptide
  XENP019890 vlCDR3
QQYGSSPWT

SEQ ID NO: 1470 - protein, 246 aa, Artificial Sequence
  Description of Artificial Sequence: Synthetic polypeptide
  XENP019891 [CTLA-4]_H0_L0.7_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVMTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1471 - protein, 118 aa, Artificial Sequence; identical to SEQ ID NO: 22
  Description of Artificial Sequence: Synthetic polypeptide
  VH of XENP019891

SEQ ID NO: 1472 - protein, 108 aa, Artificial Sequence
  Description of Artificial Sequence: Synthetic polypeptide
  VL of XENP019891
EIVMTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1473 - protein, 5 aa, Artificial Sequence
  Description of Artificial Sequence: Synthetic peptide
  XENP019891 vhCDR1
SYTMH

SEQ ID NO: 1474 - protein, 17 aa, Artificial Sequence
  Description of Artificial Sequence: Synthetic peptide
  XENP019891 vhCDR2
FISYDGNNKYYADSVKG

SEQ ID NO: 1475 - protein, 9 aa, Artificial Sequence
  Description of Artificial Sequence: Synthetic peptide
  XENP019891 vhCDR3
TGWLGPFDY

SEQ ID NO: 1476 - protein, 12 aa, Artificial Sequence
  Description of Artificial Sequence: Synthetic peptide
  XENP019891 vlCDR1
RASQSVGSSYLA

SEQ ID NO: 1477 - protein, 7 aa, Artificial Sequence
  Description of Artificial Sequence: Synthetic peptide
  XENP019891 vlCDR2
GAFSRAT

SEQ ID NO: 1478 - protein, 9 aa, Artificial Sequence
  Description of Artificial Sequence: Synthetic peptide
  XENP019891 vlCDR3
QQYGSSPWT

SEQ ID NO: 1479 - protein, 246 aa, Artificial Sequence
  Description of Artificial Sequence: Synthetic polypeptide
  XENP019892 [CTLA-4]_H0_L0.8_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPATLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1480 - protein, 118 aa, Artificial Sequence; identical to SEQ ID NO: 22
  Description of Artificial Sequence: Synthetic polypeptide
  VH of XENP019892

SEQ ID NO: 1481 - protein, 108 aa, Artificial Sequence
  Description of Artificial Sequence: Synthetic polypeptide
  VL of XENP019892
EIVLTQSPATLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1482 - protein, 5 aa, Artificial Sequence
  Description of Artificial Sequence: Synthetic peptide
  XENP019892 vhCDR1
SYTMH

SEQ ID NO: 1483 - protein, 17 aa, Artificial Sequence
  Description of Artificial Sequence: Synthetic peptide
  XENP019892 vhCDR2
FISYDGNNKYYADSVKG

SEQ ID NO: 1484 - protein, 9 aa, Artificial Sequence
  Description of Artificial Sequence: Synthetic peptide
  XENP019892 vhCDR3
TGWLGPFDY

SEQ ID NO: 1485 - protein, 12 aa, Artificial Sequence
  Description of Artificial Sequence: Synthetic peptide
  XENP019892 vlCDR1
RASQSVGSSYLA

SEQ ID NO: 1486 - protein, 7 aa, Artificial Sequence
  Description of Artificial Sequence: Synthetic peptide
  XENP019892 vlCDR2
GAFSRAT

SEQ ID NO: 1487 - protein, 9 aa, Artificial Sequence
  Description of Artificial Sequence: Synthetic peptide
  XENP019892 vlCDR3
QQYGSSPWT

SEQ ID NO: 1488 - protein, 246 aa, Artificial Sequence
  Description of Artificial Sequence: Synthetic polypeptide
  XENP019893 [CTLA-4]_H0_L0.9_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPPTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1489 - protein, 118 aa, Artificial Sequence; identical to SEQ ID NO: 22
  Description of Artificial Sequence: Synthetic polypeptide
  VH of XENP019893

SEQ ID NO: 1490 - protein, 108 aa, Artificial Sequence
  Description of Artificial Sequence: Synthetic polypeptide
  VL of XENP019893
EIVLTQSPPTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1491 - protein, 5 aa, Artificial Sequence
  Description of Artificial Sequence: Synthetic peptide
  XENP019893 vhCDR1
SYTMH

SEQ ID NO: 1492 - protein, 17 aa, Artificial Sequence
  Description of Artificial Sequence: Synthetic peptide
  XENP019893 vhCDR2
FISYDGNNKYYADSVKG

SEQ ID NO: 1493 - protein, 9 aa, Artificial Sequence
  Description of Artificial Sequence: Synthetic peptide
  XENP019893 vhCDR3
TGWLGPFDY

SEQ ID NO: 1494 - protein, 12 aa, Artificial Sequence
  Description of Artificial Sequence: Synthetic peptide
  XENP019893 vlCDR1
RASQSVGSSYLA

SEQ ID NO: 1495 - protein, 7 aa, Artificial Sequence
  Description of Artificial Sequence: Synthetic peptide
  XENP019893 vlCDR2
GAFSRAT

SEQ ID NO: 1496 - protein, 9 aa, Artificial Sequence
  Description of Artificial Sequence: Synthetic peptide
  XENP019893 vlCDR3
QQYGSSPWT

SEQ ID NO: 1497 - protein, 246 aa, Artificial Sequence
  Description of Artificial Sequence: Synthetic polypeptide
  XENP019894 [CTLA-4]_H0_L0.10_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPSTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1498 - protein, 118 aa, Artificial Sequence; identical to SEQ ID NO: 22
  Description of Artificial Sequence: Synthetic polypeptide
  VH of XENP019894

SEQ ID NO: 1499 - protein, 108 aa, Artificial Sequence
  Description of Artificial Sequence: Synthetic polypeptide
  VL of XENP019894
EIVLTQSPSTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1500 - protein, 5 aa, Artificial Sequence
  Description of Artificial Sequence: Synthetic peptide
  XENP019894 vhCDR1
SYTMH

SEQ ID NO: 1501 - protein, 17 aa, Artificial Sequence
  Description of Artificial Sequence: Synthetic peptide
  XENP019894 vhCDR2
FISYDGNNKYYADSVKG

SEQ ID NO: 1502 - protein, 9 aa, Artificial Sequence
  Description of Artificial Sequence: Synthetic peptide
  XENP019894 vhCDR3
TGWLGPFDY

SEQ ID NO: 1503 - protein, 12 aa, Artificial Sequence
  Description of Artificial Sequence: Synthetic peptide
  XENP019894 vlCDR1
RASQSVGSSYLA

SEQ ID NO: 1504 - protein, 7 aa, Artificial Sequence
  Description of Artificial Sequence: Synthetic peptide
  XENP019894 vlCDR2
GAFSRAT

SEQ ID NO: 1505 - protein, 9 aa, Artificial Sequence
  Description of Artificial Sequence: Synthetic peptide
  XENP019894 vlCDR3
QQYGSSPWT

SEQ ID NO: 1506 - protein, 246 aa, Artificial Sequence
  Description of Artificial Sequence: Synthetic polypeptide
  XENP019895 [CTLA-4]_H0_L0.11_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGSLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1507 - protein, 118 aa, Artificial Sequence; identical to SEQ ID NO: 22
  Description of Artificial Sequence: Synthetic polypeptide
  VH of XENP019895

SEQ ID NO: 1508 - protein, 108 aa, Artificial Sequence
  Description of Artificial Sequence: Synthetic polypeptide
  VL of XENP019895
EIVLTQSPGSLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1509 - protein, 5 aa, Artificial Sequence
  Description of Artificial Sequence: Synthetic peptide
  XENP019895 vhCDR1
SYTMH

SEQ ID NO: 1510 - protein, 17 aa, Artificial Sequence
  Description of Artificial Sequence: Synthetic peptide
  XENP019895 vhCDR2
FISYDGNNKYYADSVKG

SEQ ID NO: 1511 - protein, 9 aa, Artificial Sequence
  Description of Artificial Sequence: Synthetic peptide
  XENP019895 vhCDR3
TGWLGPFDY

SEQ ID NO: 1512 - protein, 12 aa, Artificial Sequence
  Description of Artificial Sequence: Synthetic peptide
  XENP019895 vlCDR1
RASQSVGSSYLA

SEQ ID NO: 1513 - protein, 7 aa, Artificial Sequence
  Description of Artificial Sequence: Synthetic peptide
  XENP019895 vlCDR2
GAFSRAT

SEQ ID NO: 1514 - protein, 9 aa, Artificial Sequence
  Description of Artificial Sequence: Synthetic peptide
  XENP019895 vlCDR3
QQYGSSPWT

SEQ ID NO: 1515 - protein, 246 aa, Artificial Sequence
  Description of Artificial Sequence: Synthetic polypeptide
  XENP019896 [CTLA-4]_H0_L0.12_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1516 - protein, 118 aa, Artificial Sequence; identical to SEQ ID NO: 22
  Description of Artificial Sequence: Synthetic polypeptide
  VH of XENP019896

SEQ ID NO: 1517 - protein, 108 aa, Artificial Sequence
  Description of Artificial Sequence: Synthetic polypeptide
  VL of XENP019896
EIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1518 - protein, 5 aa, Artificial Sequence
  Description of Artificial Sequence: Synthetic peptide
  XENP019896 vhCDR1
SYTMH

SEQ ID NO: 1519 - protein, 17 aa, Artificial Sequence
  Description of Artificial Sequence: Synthetic peptide
  XENP019896 vhCDR2
FISYDGNNKYYADSVKG

SEQ ID NO: 1520 - protein, 9 aa, Artificial Sequence
  Description of Artificial Sequence: Synthetic peptide
  XENP019896 vhCDR3
TGWLGPFDY

SEQ ID NO: 1521 - protein, 12 aa, Artificial Sequence
  Description of Artificial Sequence: Synthetic peptide
  XENP019896 vlCDR1
RASQSVGSSYLA

SEQ ID NO: 1522 - protein, 7 aa, Artificial Sequence
  Description of Artificial Sequence: Synthetic peptide
  XENP019896 vlCDR2
GAFSRAT

SEQ ID NO: 1523 - protein, 9 aa, Artificial Sequence
  Description of Artificial Sequence: Synthetic peptide
  XENP019896 vlCDR3
QQYGSSPWT

SEQ ID NO: 1524 - protein, 246 aa, Artificial Sequence
  Description of Artificial Sequence: Synthetic polypeptide
  XENP019901 [CTLA-4]_H0_L0.13_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGEPATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1525 - protein, 118 aa, Artificial Sequence; identical to SEQ ID NO: 22
  Description of Artificial Sequence: Synthetic polypeptide
  VH of XENP019901

SEQ ID NO: 1526 - protein, 108 aa, Artificial Sequence
  Description of Artificial Sequence: Synthetic polypeptide
  VL of XENP019901
EIVLTQSPGTLSLSPGEPATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1527 - protein, 5 aa, Artificial Sequence
  Description of Artificial Sequence: Synthetic peptide
  XENP019901 vhCDR1
SYTMH

SEQ ID NO: 1528 - protein, 17 aa, Artificial Sequence
  Description of Artificial Sequence: Synthetic peptide
  XENP019901 vhCDR2
FISYDGNNKYYADSVKG

SEQ ID NO: 1529 - protein, 9 aa, Artificial Sequence
  Description of Artificial Sequence: Synthetic peptide
  XENP019901 vhCDR3
TGWLGPFDY

SEQ ID NO: 1530 - protein, 12 aa, Artificial Sequence
  Description of Artificial Sequence: Synthetic peptide
  XENP019901 vlCDR1
RASQSVGSSYLA

SEQ ID NO: 1531 - protein, 7 aa, Artificial Sequence
  Description of Artificial Sequence: Synthetic peptide
  XENP019901 vlCDR2
GAFSRAT

SEQ ID NO: 1532 - protein, 9 aa, Artificial Sequence
  Description of Artificial Sequence: Synthetic peptide
  XENP019901 vlCDR3
QQYGSSPWT

SEQ ID NO: 1533 - protein, 246 aa, Artificial Sequence
  Description of Artificial Sequence: Synthetic polypeptide
  XENP019902 [CTLA-4]_H0_L0.14_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGEQATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1534 - protein, 118 aa, Artificial Sequence; identical to SEQ ID NO: 22
  Description of Artificial Sequence: Synthetic polypeptide
  VH of XENP019902

SEQ ID NO: 1535 - protein, 108 aa, Artificial Sequence
  Description of Artificial Sequence: Synthetic polypeptide
  VL of XENP019902
EIVLTQSPGTLSLSPGEQATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1536 - protein, 5 aa, Artificial Sequence
  Description of Artificial Sequence: Synthetic peptide
  XENP019902 vhCDR1
SYTMH

SEQ ID NO: 1537 - protein, 17 aa, Artificial Sequence
  Description of Artificial Sequence: Synthetic peptide
  XENP019902 vhCDR2
FISYDGNNKYYADSVKG

SEQ ID NO: 1538 - protein, 9 aa, Artificial Sequence
  Description of Artificial Sequence: Synthetic peptide
  XENP019902 vhCDR3
TGWLGPFDY

SEQ ID NO: 1539 - protein, 12 aa, Artificial Sequence
  Description of Artificial Sequence: Synthetic peptide
  XENP019902 vlCDR1
RASQSVGSSYLA

SEQ ID NO: 1540 - protein, 7 aa, Artificial Sequence
  Description of Artificial Sequence: Synthetic peptide
  XENP019902 vlCDR2
GAFSRAT

SEQ ID NO: 1541 - protein, 9 aa, Artificial Sequence
  Description of Artificial Sequence: Synthetic peptide
  XENP019902 vlCDR3
QQYGSSPWT

SEQ ID NO: 1542 - protein, 246 aa, Artificial Sequence
  Description of Artificial Sequence: Synthetic polypeptide
  XENP019903 [CTLA-4]_H0_L0.15_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERVTLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1543 - protein, 118 aa, Artificial Sequence; identical to SEQ ID NO: 22
  Description of Artificial Sequence: Synthetic polypeptide
  VH of XENP019903

SEQ ID NO: 1544 - protein, 108 aa, Artificial Sequence
  Description of Artificial Sequence: Synthetic polypeptide
  VL of XENP019903
EIVLTQSPGTLSLSPGERVTLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1545 - protein, 5 aa, Artificial Sequence
  Description of Artificial Sequence: Synthetic peptide
  XENP019903 vhCDR1
SYTMH

SEQ ID NO: 1546 - protein, 17 aa, Artificial Sequence
  Description of Artificial Sequence: Synthetic peptide
  XENP019903 vhCDR2
FISYDGNNKYYADSVKG

SEQ ID NO: 1547 - protein, 9 aa, Artificial Sequence
  Description of Artificial Sequence: Synthetic peptide
  XENP019903 vhCDR3
TGWLGPFDY

SEQ ID NO: 1548 - protein, 12 aa, Artificial Sequence
  Description of Artificial Sequence: Synthetic peptide
  XENP019903 vlCDR1
RASQSVGSSYLA

SEQ ID NO: 1549 - protein, 7 aa, Artificial Sequence
  Description of Artificial Sequence: Synthetic peptide
  XENP019903 vlCDR2
GAFSRAT

SEQ ID NO: 1550 - protein, 9 aa, Artificial Sequence
  Description of Artificial Sequence: Synthetic peptide
  XENP019903 vlCDR3
QQYGSSPWT

SEQ ID NO: 1551 - protein, 246 aa, Artificial Sequence
  Description of Artificial Sequence: Synthetic polypeptide
  XENP019904 [CTLA-4]_H0_L0.16_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERASLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1552 - protein, 118 aa, Artificial Sequence; identical to SEQ ID NO: 22
  Description of Artificial Sequence: Synthetic polypeptide
  VH of XENP019904

SEQ ID NO: 1553 - protein, 108 aa, Artificial Sequence
  Description of Artificial Sequence: Synthetic polypeptide
  VL of XENP019904
EIVLTQSPGTLSLSPGERASLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1554 - protein, 5 aa, Artificial Sequence
  Description of Artificial Sequence: Synthetic peptide
  XENP019904 vhCDR1
SYTMH

SEQ ID NO: 1555 - protein, 17 aa, Artificial Sequence
  Description of Artificial Sequence: Synthetic peptide
  XENP019904 vhCDR2
FISYDGNNKYYADSVKG

SEQ ID NO: 1556 - protein, 9 aa, Artificial Sequence
  Description of Artificial Sequence: Synthetic peptide
  XENP019904 vhCDR3
TGWLGPFDY

SEQ ID NO: 1557 - protein, 12 aa, Artificial Sequence
  Description of Artificial Sequence: Synthetic peptide
  XENP019904 vlCDR1
RASQSVGSSYLA

SEQ ID NO: 1558 - protein, 7 aa, Artificial Sequence
  Description of Artificial Sequence: Synthetic peptide
  XENP019904 vlCDR2
GAFSRAT

SEQ ID NO: 1559 - protein, 9 aa, Artificial Sequence
  Description of Artificial Sequence: Synthetic peptide
  XENP019904 vlCDR3
QQYGSSPWT

SEQ ID NO: 1560 - protein, 246 aa, Artificial Sequence
  Description of Artificial Sequence: Synthetic polypeptide
  XENP019905 [CTLA-4]_H0_L0.17_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATISCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1561 - protein, 118 aa, Artificial Sequence; identical to SEQ ID NO: 22
  Description of Artificial Sequence: Synthetic polypeptide
  VH of XENP019905

SEQ ID NO: 1562 - protein, 108 aa, Artificial Sequence
  Description of Artificial Sequence: Synthetic polypeptide
  VL of XENP019905
EIVLTQSPGTLSLSPGERATISCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1563 - protein, 5 aa, Artificial Sequence
  Description of Artificial Sequence: Synthetic peptide
  XENP019905 vhCDR1
SYTMH

SEQ ID NO: 1564 - protein, 17 aa, Artificial Sequence
  Description of Artificial Sequence: Synthetic peptide
  XENP019905 vhCDR2
FISYDGNNKYYADSVKG

SEQ ID NO: 1565 - protein, 9 aa, Artificial Sequence
  Description of Artificial Sequence: Synthetic peptide
  XENP019905 vhCDR3
TGWLGPFDY

SEQ ID NO: 1566 - protein, 12 aa, Artificial Sequence
  Description of Artificial Sequence: Synthetic peptide
  XENP019905 vlCDR1
RASQSVGSSYLA

SEQ ID NO: 1567 - protein, 7 aa, Artificial Sequence
  Description of Artificial Sequence: Synthetic peptide
  XENP019905 vlCDR2
GAFSRAT

SEQ ID NO: 1568 - protein, 9 aa, Artificial Sequence
  Description of Artificial Sequence: Synthetic peptide
  XENP019905 vlCDR3
QQYGSSPWT

SEQ ID NO: 1569 - protein, 246 aa, Artificial Sequence
  Description of Artificial Sequence: Synthetic polypeptide
  XENP019906 [CTLA-4]_H0_L0.18_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRSSQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1570 - protein, 118 aa, Artificial Sequence; identical to SEQ ID NO: 22
  Description of Artificial Sequence: Synthetic polypeptide
  VH of XENP019906

SEQ ID NO: 1571 - protein, 108 aa, Artificial Sequence
  Description of Artificial Sequence: Synthetic polypeptide
  VL of XENP019906
EIVLTQSPGTLSLSPGERATLSCRSSQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 1572 - protein, 5 aa, Artificial Sequence
  Description of Artificial Sequence: Synthetic peptide
  XENP019906 vhCDR1
SYTMH

SEQ ID NO: 1573 - protein, 17 aa, Artificial Sequence
  Description of Artificial Sequence: Synthetic peptide
  XENP019906 vhCDR2
FISYDGNNKYYADSVKG

SEQ ID NO: 1574 - protein, 9 aa, Artificial Sequence
  Description of Artificial Sequence: Synthetic peptide
  XENP019906 vhCDR3
TGWLGPFDY

SEQ ID NO: 1575 - protein, 12 aa, Artificial Sequence
  Description of Artificial Sequence: Synthetic peptide
  XENP019906 vlCDR1
RSSQSVGSSYLA

SEQ ID NO: 1576 - protein, 7 aa, Artificial Sequence
  Description of Artificial Sequence: Synthetic peptide
  XENP019906 vlCDR2
GAFSRAT

SEQ ID NO: 1577 - protein, 9 aa, Artificial Sequence
  Description of Artificial Sequence: Synthetic peptide
  XENP019906 vlCDR3
QQYGSSPWT

SEQ ID NO: 1578 - protein, 246 aa, Artificial Sequence
  Description of Artificial Sequence: Synthetic polypeptide
  XENP019907 [CTLA-4]_H0_L0.19_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSDGSSYLAWYQQKPGQAPRLLIYGAFSRATGIPDRFSGSGSGTDFTLTISRLEPEDFAVYYCQQYGSSPWTFGQGTKVEIK

SEQ ID NO: 1579 - protein, 118 aa, Artificial Sequence; identical to SEQ ID NO: 22
  Description of Artificial Sequence: Synthetic polypeptide
  VH of XENP019907

SEQ ID NO: 1580 - protein, 108 aa, Artificial Sequence
  Description of Artificial Sequence: Synthetic polypeptide
  VL of XENP019907
EIVLTQSPGTLSLSPGERATLSCRASQSDGSSYLAWYQQKPGQAPRLLIYGAFSRATGIPDRFSGSGSGTDFTLTISRLEPEDFAVYYCQQYGSSPWTFGQGTKVEIK

SEQ ID NO: 1581 - protein, 5 aa, Artificial Sequence
  Description of Artificial Sequence: Synthetic peptide
  XENP019907 vhCDR1
SYTMH

SEQ ID NO: 1582 - protein, 17 aa, Artificial Sequence
  Description of Artificial Sequence: Synthetic peptide
  XENP019907 vhCDR2
FISYDGNNKYYADSVKG

SEQ ID NO: 1583 - protein, 9 aa, Artificial Sequence
  Description of Artificial Sequence: Synthetic peptide
  XENP019907 vhCDR3
TGWLGPFDY

SEQ ID NO: 1584 - protein, 12 aa, Artificial Sequence
  Description of Artificial Sequence: Synthetic peptide
  XENP019907 vlCDR1
RASQSDGSSYLA

SEQ ID NO: 1585 - protein, 7 aa, Artificial Sequence
  Description of Artificial Sequence: Synthetic peptide
  XENP019907 vlCDR2
GAFSRAT

SEQ ID NO: 1586 - protein, 9 aa, Artificial Sequence
  Description of Artificial Sequence: Synthetic peptide
  XENP019907 vlCDR3
QQYGSSPWT

SEQ ID NO: 1587 - protein, 246 aa, Artificial Sequence
  Description of Artificial Sequence: Synthetic polypeptide
  XENP019908 [CTLA-4]_H0_L0.20_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSSGSSYLAWYQQKPGQAPRLLIYGAFSRATGIPDRFSGSGSGTDFTLTISRLEPEDFAVYYCQQYGSSPWTFGQGTKVEIK

SEQ ID NO: 1588 - protein, 118 aa, Artificial Sequence; identical to SEQ ID NO: 22
  Description of Artificial Sequence: Synthetic polypeptide
  VH of XENP019908

SEQ ID NO: 1589 - protein, 108 aa, Artificial Sequence
  Description of Artificial Sequence: Synthetic polypeptide
  VL of XENP019908
EIVLTQSPGTLSLSPGERATLSCRASQSSGSSYLAWYQQKPGQAPRLLIYGAFSRATGIPDRFSGSGSGTDFTLTISRLEPEDFAVYYCQQYGSSPWTFGQGTKVEIK

SEQ ID NO: 1590 - protein, 5 aa, Artificial Sequence
  Description of Artificial Sequence: Synthetic peptide
  XENP019908 vhCDR1
SYTMH

SEQ ID NO: 1591 - protein, 17 aa, Artificial Sequence
  Description of Artificial Sequence: Synthetic peptide
  XENP019908 vhCDR2
FISYDGNNKYYADSVKG

SEQ ID NO: 1592 - protein, 9 aa, Artificial Sequence
  Description of Artificial Sequence: Synthetic peptide
  XENP019908 vhCDR3
TGWLGPFDY

SEQ ID NO: 1593 - protein, 12 aa, Artificial Sequence
  Description of Artificial Sequence: Synthetic peptide
  XENP019908 vlCDR1
RASQSSGSSYLA

SEQ ID NO: 1594 - protein, 7 aa, Artificial Sequence
  Description of Artificial Sequence: Synthetic peptide
  XENP019908 vlCDR2
GAFSRAT

SEQ ID NO: 1595 - protein, 9 aa, Artificial Sequence
  Description of Artificial Sequence: Synthetic peptide
  XENP019908 vlCDR3
QQYGSSPWT

SEQ ID NO: 1596 - protein, 246 aa, Artificial Sequence
  Description of Artificial Sequence: Synthetic polypeptide
  XENP019909 [CTLA-4]_H0_L0.21_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVASSYLAWYQQKPGQAPRLLIYGAFSRATGIPDRFSGSGSGTDFTLTISRLEPEDFAVYYCQQYGSSPWTFGQGTKVEIK

SEQ ID NO: 1597 - protein, 118 aa, Artificial Sequence; identical to SEQ ID NO: 22
  Description of Artificial Sequence: Synthetic polypeptide
  VH of XENP019909

SEQ ID NO: 1598 - protein, 108 aa, Artificial Sequence
  Description of Artificial Sequence: Synthetic polypeptide
  VL of XENP019909
EIVLTQSPGTLSLSPGERATLSCRASQSVASSYLAWYQQKPGQAPRLLIYGAFSRATGIPDRFSGSGSGTDFTLTISRLEPEDFAVYYCQQYGSSPWTFGQGTKVEIK

SEQ ID NO: 1599 - protein, 5 aa, Artificial Sequence
  Description of Artificial Sequence: Synthetic peptide
  XENP019909 vhCDR1
SYTMH

SEQ ID NO: 1600 - protein, 17 aa, Artificial Sequence
  Description of Artificial Sequence: Synthetic peptide
  XENP019909 vhCDR2
FISYDGNNKYYADSVKG

SEQ ID NO: 1601 - protein, 9 aa, Artificial Sequence
  Description of Artificial Sequence: Synthetic peptide
  XENP019909 vhCDR3
TGWLGPFDY

SEQ ID NO: 1602 - protein, 12 aa, Artificial Sequence
  Description of Artificial Sequence: Synthetic peptide
  XENP019909 vlCDR1
RASQSVASSYLA

SEQ ID NO: 1603 - protein, 7 aa, Artificial Sequence
  Description of Artificial Sequence: Synthetic peptide
  XENP019909 vlCDR2
GAFSRAT

SEQ ID NO: 1604 - protein, 9 aa, Artificial Sequence
  Description of Artificial Sequence: Synthetic peptide
  XENP019909 vlCDR3
QQYGSSPWT

SEQ ID NO: 1605 - protein, 246 aa, Artificial Sequence
  Description of Artificial Sequence: Synthetic polypeptide
  XENP019910 [CTLA-4]_H0_L0.22_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVSSSYLAWYQQKPGQAPRLLIYGAFSRATGIPDRFSGSGSGTDFTLTISRLEPEDFAVYYCQQYGSSPWTFGQGTKVEIK

SEQ ID NO: 1606 - protein, 118 aa, Artificial Sequence; identical to SEQ ID NO: 22
  Description of Artificial Sequence: Synthetic polypeptide
  VH of XENP019910

SEQ ID NO: 1607 - protein, 108 aa, Artificial Sequence
  Description of Artificial Sequence: Synthetic polypeptide
  VL of XENP019910
EIVLTQSPGTLSLSPGERATLSCRASQSVSSSYLAWYQQKPGQAPRLLIYGAFSRATGIPDRFSGSGSGTDFTLTISRLEPEDFAVYYCQQYGSSPWTFGQGTKVEIK

SEQ ID NO: 1608 - protein, 5 aa, Artificial Sequence
  Description of Artificial Sequence: Synthetic peptide
  XENP019910 vhCDR1
SYTMH

SEQ ID NO: 1609 - protein, 17 aa, Artificial Sequence
  Description of Artificial Sequence: Synthetic peptide
  XENP019910 vhCDR2
FISYDGNNKYYADSVKG

SEQ ID NO: 1610 - protein, 9 aa, Artificial Sequence
  Description of Artificial Sequence: Synthetic peptide
  XENP019910 vhCDR3
TGWLGPFDY

SEQ ID NO: 1611 - protein, 12 aa, Artificial Sequence
  Description of Artificial Sequence: Synthetic peptide
  XENP019910 vlCDR1
RASQSVSSSYLA

SEQ ID NO: 1612 - protein, 7 aa, Artificial Sequence
  Description of Artificial Sequence: Synthetic peptide
  XENP019910 vlCDR2
GAFSRAT

SEQ ID NO: 1613 - protein, 9 aa, Artificial Sequence
  Description of Artificial Sequence: Synthetic peptide
  XENP019910 vlCDR3
QQYGSSPWT

SEQ ID NO: 1614 - protein, 246 aa, Artificial Sequence
  Description of Artificial Sequence: Synthetic polypeptide
  XENP019911 [CTLA-4]_H0_L0.23_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVTSSYLAWYQQKPGQAPRLLIYGAFSRATGIPDRFSGSGSGTDFTLTISRLEPEDFAVYYCQQYGSSPWTFGQGTKVEIK

SEQ ID NO: 1615 - protein, 118 aa, Artificial Sequence; identical to SEQ ID NO: 22
  Description of Artificial Sequence: Synthetic polypeptide
  VH of XENP019911

SEQ ID NO: 1616 - protein, 108 aa, Artificial Sequence
  Description of Artificial Sequence: Synthetic polypeptide
  VL of XENP019911
EIVLTQSPGTLSLSPGERATLSCRASQSVTSSYLAWYQQKPGQAPRLLIYGAFSRATGIPDRFSGSGSGTDFTLTISRLEPEDFAVYYCQQYGSSPWTFGQGTKVEIK

SEQ ID NO: 1617 - protein, 5 aa, Artificial Sequence
  Description of Artificial Sequence: Synthetic peptide
  XENP019911 vhCDR1
SYTMH

SEQ ID NO: 1618 - protein, 17 aa, Artificial Sequence
  Description of Artificial Sequence: Synthetic peptide
  XENP019911 vhCDR2
FISYDGNNKYYADSVKG

SEQ ID NO: 1619 - protein, 9 aa, Artificial Sequence
  Description of Artificial Sequence: Synthetic peptide
  XENP019911 vhCDR3
TGWLGPFDY

SEQ ID NO: 1620 - protein, 12 aa, Artificial Sequence
  Description of Artificial Sequence: Synthetic peptide
  XENP019911 vlCDR1
RASQSVTSSYLA

SEQ ID NO: 1621 - protein, 7 aa, Artificial Sequence
  Description of Artificial Sequence: Synthetic peptide
  XENP019911 vlCDR2
GAFSRAT

SEQ ID NO: 1622 - protein, 9 aa, Artificial Sequence
  Description of Artificial Sequence: Synthetic peptide
  XENP019911 vlCDR3
QQYGSSPWT

SEQ ID NO: 1623 - protein, 246 aa, Artificial Sequence
  Description of Artificial Sequence: Synthetic polypeptide
  XENP019912 [CTLA-4]_H0_L0.24_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGASYLAWYQQKPGQAPRLLIYGAFSRATGIPDRFSGSGSGTDFTLTISRLEPEDFAVYYCQQYGSSPWTFGQGTKVEIK

SEQ ID NO: 1624 - protein, 118 aa, Artificial Sequence; identical to SEQ ID NO: 22
  Description of Artificial Sequence: Synthetic polypeptide
  VH of XENP019912

SEQ ID NO: 1625 - protein, 108 aa, Artificial Sequence
  Description of Artificial Sequence: Synthetic polypeptide
  VL of XENP019912
EIVLTQSPGTLSLSPGERATLSCRASQSVGASYLAWYQQKPGQAPRLLIYGAFSRATGIPDRFSGSGSGTDFTLTISRLEPEDFAVYYCQQYGSSPWTFGQGTKVEIK

SEQ ID NO: 1626 - protein, 5 aa, Artificial Sequence
  Description of Artificial Sequence: Synthetic peptide
  XENP019912 vhCDR1
SYTMH

SEQ ID NO: 1627 - protein, 17 aa, Artificial Sequence
  Description of Artificial Sequence: Synthetic peptide
  XENP019912 vhCDR2
FISYDGNNKYYADSVKG

SEQ ID NO: 1628 - protein, 9 aa, Artificial Sequence
  Description of Artificial Sequence: Synthetic peptide
  XENP019912 vhCDR3
TGWLGPFDY

SEQ ID NO: 1629 - protein, 12 aa, Artificial Sequence
  Description of Artificial Sequence: Synthetic peptide
  XENP019912 vlCDR1
RASQSVGASYLA

SEQ ID NO: 1630 - protein, 7 aa, Artificial Sequence
  Description of Artificial Sequence: Synthetic peptide
  XENP019912 vlCDR2
GAFSRAT

SEQ ID NO: 1631 - protein, 9 aa, Artificial Sequence
  Description of Artificial Sequence: Synthetic peptide
  XENP019912 vlCDR3
QQYGSSPWT

SEQ ID NO: 1632 - protein, 246 aa, Artificial Sequence
  Description of Artificial Sequence: Synthetic polypeptide
  XENP019913 [CTLA-4]_H0_L0.25_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGGSYLAWYQQKPGQAPRLLIYGAFSRATGIPDRFSGSGSGTDFTLTISRLEPEDFAVYYCQQYGSSPWTFGQGTKVEIK

SEQ ID NO: 1633 - protein, 118 aa, Artificial Sequence; identical to SEQ ID NO: 22
  Description of Artificial Sequence: Synthetic polypeptide
  VH of XENP019913

SEQ ID NO: 1634 - protein, 108 aa, Artificial Sequence
  Description of Artificial Sequence: Synthetic polypeptide
  VL of XENP019913
EIVLTQSPGTLSLSPGERATLSCRASQSVGGSYLAWYQQKPGQAPRLLIYGAFSRATGIPDRFSGSGSGTDFTLTISRLEPEDFAVYYCQQYGSSPWTFGQGTKVEIK

SEQ ID NO: 1635 - protein, 5 aa, Artificial Sequence
  Description of Artificial Sequence: Synthetic peptide
  XENP019913 vhCDR1
SYTMH

SEQ ID NO: 1636 - protein, 17 aa, Artificial Sequence
  Description of Artificial Sequence: Synthetic peptide
  XENP019913 vhCDR2
FISYDGNNKYYADSVKG

SEQ ID NO: 1637 - protein, 9 aa, Artificial Sequence
  Description of Artificial Sequence: Synthetic peptide
  XENP019913 vhCDR3
TGWLGPFDY

SEQ ID NO: 1638 - protein, 12 aa, Artificial Sequence
  Description of Artificial Sequence: Synthetic peptide
  XENP019913 vlCDR1
RASQSVGGSYLA

SEQ ID NO: 1639 - protein, 7 aa, Artificial Sequence
  Description of Artificial Sequence: Synthetic peptide
  XENP019913 vlCDR2
GAFSRAT

SEQ ID NO: 1640 - protein, 9 aa, Artificial Sequence
  Description of Artificial Sequence: Synthetic peptide
  XENP019913 vlCDR3
QQYGSSPWT

SEQ ID NO: 1641 - protein, 246 aa, Artificial Sequence
  Description of Artificial Sequence: Synthetic polypeptide
  XENP019914 [CTLA-4]_H0_L0.26_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGNSYLAWYQQKPGQAPRLLIYGAFSRATGIPDRFSGSGSGTDFTLTISRLEPEDFAVYYCQQYGSSPWTFGQGTKVEIK

SEQ ID NO: 1642 - protein, 118 aa, Artificial Sequence; identical to SEQ ID NO: 22
  Description of Artificial Sequence: Synthetic polypeptide
  VH of XENP019914

SEQ ID NO: 1643 - protein, 108 aa, Artificial Sequence
  Description of Artificial Sequence: Synthetic polypeptide
  VL of XENP019914
EIVLTQSPGTLSLSPGERATLSCRASQSVGNSYLAWYQQKPGQAPRLLIYGAFSRATGIPDRFSGSGSGTDFTLTISRLEPEDFAVYYCQQYGSSPWTFGQGTKVEIK

SEQ ID NO: 1644 - protein, 5 aa, Artificial Sequence
  Description of Artificial Sequence: Synthetic peptide
  XENP019914 vhCDR1
SYTMH

SEQ ID NO: 1645 - protein, 17 aa, Artificial Sequence
  Description of Artificial Sequence: Synthetic peptide
  XENP019914 vhCDR2
FISYDGNNKYYADSVKG

SEQ ID NO: 1646 - protein, 9 aa, Artificial Sequence
  Description of Artificial Sequence: Synthetic peptide
  XENP019914 vhCDR3
TGWLGPFDY

SEQ ID NO: 1647 - protein, 12 aa, Artificial Sequence
  Description of Artificial Sequence: Synthetic peptide
  XENP019914 vlCDR1
RASQSVGNSYLA

SEQ ID NO: 1648 - protein, 7 aa, Artificial Sequence
  Description of Artificial Sequence: Synthetic peptide
  XENP019914 vlCDR2
GAFSRAT

SEQ ID NO: 1649 - protein, 9 aa, Artificial Sequence
  Description of Artificial Sequence: Synthetic peptide
  XENP019914 vlCDR3
QQYGSSPWT

SEQ ID NO: 1650 - protein, 246 aa, Artificial Sequence
  Description of Artificial Sequence: Synthetic polypeptide
  XENP019915 [CTLA-4]_H0_L0.27_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGQSYLAWYQQKPGQAPRLLIYGAFSRATGIPDRFSGSGSGTDFTLTISRLEPEDFAVYYCQQYGSSPWTFGQGTKVEIK

SEQ ID NO: 1651 - protein, 118 aa, Artificial Sequence; identical to SEQ ID NO: 22
  Description of Artificial Sequence: Synthetic polypeptide
  VH of XENP019915

SEQ ID NO: 1652 - protein, 108 aa, Artificial Sequence
  Description of Artificial Sequence: Synthetic polypeptide
  VL of XENP019915
EIVLTQSPGTLSLSPGERATLSCRASQSVGQSYLAWYQQKPGQAPRLLIYGAFSRATGIPDRFSGSGSGTDFTLTISRLEPEDFAVYYCQQYGSSPWTFGQGTKVEIK

SEQ ID NO: 1653 - protein, 5 aa, Artificial Sequence
  Description of Artificial Sequence: Synthetic peptide
  XENP019915 vhCDR1
SYTMH

SEQ ID NO: 1654 - protein, 17 aa, Artificial Sequence
  Description of Artificial Sequence: Synthetic peptide
  XENP019915 vhCDR2
FISYDGNNKYYADSVKG

SEQ ID NO: 1655 - protein, 9 aa, Artificial Sequence
  Description of Artificial Sequence: Synthetic peptide
  XENP019915 vhCDR3
TGWLGPFDY

SEQ ID NO: 1656 - protein, 12 aa, Artificial Sequence
  Description of Artificial Sequence: Synthetic peptide
  XENP019915 vlCDR1
RASQSVGQSYLA

SEQ ID NO: 1657 - protein, 7 aa, Artificial Sequence
  Description of Artificial Sequence: Synthetic peptide
  XENP019915 vlCDR2
GAFSRAT

SEQ ID NO: 1658 - protein, 9 aa, Artificial Sequence
  Description of Artificial Sequence: Synthetic peptide
  XENP019915 vlCDR3
QQYGSSPWT

SEQ ID NO: 1659 - protein, 246 aa, Artificial Sequence
  Description of Artificial Sequence: Synthetic polypeptide
  XENP019916 [CTLA-4]_H0_L0.28_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGTSYLAWYQQKPGQAPRLLIYGAFSRATGIPDRFSGSGSGTDFTLTISRLEPEDFAVYYCQQYGSSPWTFGQGTKVEIK

SEQ ID NO: 1660 - protein, 118 aa, Artificial Sequence; identical to SEQ ID NO: 22
  Description of Artificial Sequence: Synthetic polypeptide
  VH of XENP019916

SEQ ID NO: 1661 - protein, 108 aa, Artificial Sequence
  Description of Artificial Sequence: Synthetic polypeptide
  VL of XENP019916
EIVLTQSPGTLSLSPGERATLSCRASQSVGTSYLAWYQQKPGQAPRLLIYGAFSRATGIPDRFSGSGSGTDFTLTISRLEPEDFAVYYCQQYGSSPWTFGQGTKVEIK

SEQ ID NO: 1662 - protein, 5 aa, Artificial Sequence
  Description of Artificial Sequence: Synthetic peptide
  XENP019916 vhCDR1
SYTMH

SEQ ID NO: 1663 - protein, 17 aa, Artificial Sequence
  Description of Artificial Sequence: Synthetic peptide
  XENP019916 vhCDR2
FISYDGNNKYYADSVKG

SEQ ID NO: 1664 - protein, 9 aa, Artificial Sequence
  Description of Artificial Sequence: Synthetic peptide
  XENP019916 vhCDR3
TGWLGPFDY

SEQ ID NO: 1665 - protein, 12 aa, Artificial Sequence
  Description of Artificial Sequence: Synthetic peptide
  XENP019916 vlCDR1
RASQSVGTSYLA

SEQ ID NO: 1666 - protein, 7 aa, Artificial Sequence
  Description of Artificial Sequence: Synthetic peptide
  XENP019916 vlCDR2
GAFSRAT

SEQ ID NO: 1667 - protein, 9 aa, Artificial Sequence
  Description of Artificial Sequence: Synthetic peptide
  XENP019916 vlCDR3
QQYGSSPWT

SEQ ID NO: 1668 - protein, 246 aa, Artificial Sequence
  Description of Artificial Sequence: Synthetic polypeptide
  XENP019917 [CTLA-4]_H0_L0.29_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSAYLAWYQQKPGQAPRLLIYGAFSRATGIPDRFSGSGSGTDFTLTISRLEPEDFAVYYCQQYGSSPWTFGQGTKVEIK

SEQ ID NO: 1669 - protein, 118 aa, Artificial Sequence; identical to SEQ ID NO: 22
  Description of Artificial Sequence: Synthetic polypeptide
  VH of XENP019917

SEQ ID NO: 1670 - protein, 108 aa, Artificial Sequence
  Description of Artificial Sequence: Synthetic polypeptide
  VL of XENP019917
EIVLTQSPGTLSLSPGERATLSCRASQSVGSAYLAWYQQKPGQAPRLLIYGAFSRATGIPDRFSGSGSGTDFTLTISRLEPEDFAVYYCQQYGSSPWTFGQGTKVEIK

SEQ ID NO: 1671 - protein, 5 aa, Artificial Sequence
  Description of Artificial Sequence: Synthetic peptide
  XENP019917 vhCDR1
SYTMH

SEQ ID NO: 1672 - protein, 17 aa, Artificial Sequence
  Description of Artificial Sequence: Synthetic peptide
  XENP019917 vhCDR2
FISYDGNNKYYADSVKG

SEQ ID NO: 1673 - protein, 9 aa, Artificial Sequence
  Description of Artificial Sequence: Synthetic peptide
  XENP019917 vhCDR3
TGWLGPFDY

SEQ ID NO: 1674 - protein, 12 aa, Artificial Sequence
  Description of Artificial Sequence: Synthetic peptide
  XENP019917 vlCDR1
RASQSVGSAYLA

SEQ ID NO: 1675 - protein, 7 aa, Artificial Sequence
  Description of Artificial Sequence: Synthetic peptide
  XENP019917 vlCDR2
GAFSRAT

SEQ ID NO: 1676 - protein, 9 aa, Artificial Sequence
  Description of Artificial Sequence: Synthetic peptide
  XENP019917 vlCDR3
QQYGSSPWT

SEQ ID NO: 1677 - protein, 246 aa, Artificial Sequence
  Description of Artificial Sequence: Synthetic polypeptide
  XENP019918 [CTLA-4]_H0_L0.30_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSGYLAWYQQKPGQAPRLLIYGAFSRATGIPDRFSGSGSGTDFTLTISRLEPEDFAVYYCQQYGSSPWTFGQGTKVEIK

SEQ ID NO: 1678 - protein, 118 aa, Artificial Sequence; identical to SEQ ID NO: 22
  Description of Artificial Sequence: Synthetic polypeptide
  VH of XENP019918

SEQ ID NO: 1679 - protein, 108 aa, Artificial Sequence
  Description of Artificial Sequence: Synthetic polypeptide
  VL of XENP019918
EIVLTQSPGTLSLSPGERATLSCRASQSVGSGYLAWYQQKPGQAPRLLIYGAFSRATGIPDRFSGSGSGTDFTLTISRLEPEDFAVYYCQQYGSSPWTFGQGTKVEIK

SEQ ID NO: 1680 - protein, 5 aa, Artificial Sequence
  Description of Artificial Sequence: Synthetic peptide
  XENP019918 vhCDR1
SYTMH

SEQ ID NO: 1681 - protein, 17 aa, Artificial Sequence
  Description of Artificial Sequence: Synthetic peptide
  XENP019918 vhCDR2
FISYDGNNKYYADSVKG

SEQ ID NO: 1682 - protein, 9 aa, Artificial Sequence
  Description of Artificial Sequence: Synthetic peptide
  XENP019918 vhCDR3
TGWLGPFDY

SEQ ID NO: 1683 - protein, 12 aa, Artificial Sequence
  Description of Artificial Sequence: Synthetic peptide
  XENP019918 vlCDR1
RASQSVGSGYLA

SEQ ID NO: 1684 - protein, 7 aa, Artificial Sequence
  Description of Artificial Sequence: Synthetic peptide
  XENP019918 vlCDR2
GAFSRAT

SEQ ID NO: 1685 - protein, 9 aa, Artificial Sequence
  Description of Artificial Sequence: Synthetic peptide
  XENP019918 vlCDR3
QQYGSSPWT

SEQ ID NO: 1686 - protein, 246 aa, Artificial Sequence
  Description of Artificial Sequence: Synthetic polypeptide
  XENP019919 [CTLA-4]_H0_L0.31_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSNYLAWYQQKPGQAPRLLIYGAFSRATGIPDRFSGSGSGTDFTLTISRLEPEDFAVYYCQQYGSSPWTFGQGTKVEIK

SEQ ID NO: 1687 - protein, 118 aa, Artificial Sequence; identical to SEQ ID NO: 22
  Description of Artificial Sequence: Synthetic polypeptide
  VH of XENP019919

SEQ ID NO: 1688 - protein, 108 aa, Artificial Sequence
  Description of Artificial Sequence: Synthetic polypeptide
  VL of XENP019919
EIVLTQSPGTLSLSPGERATLSCRASQSVGSNYLAWYQQKPGQAPRLLIYGAFSRATGIPDRFSGSGSGTDFTLTISRLEPEDFAVYYCQQYGSSPWTFGQGTKVEIK

SEQ ID NO: 1689 - protein, 5 aa, Artificial Sequence
  Description of Artificial Sequence: Synthetic peptide
  XENP019919 vhCDR1
SYTMH

SEQ ID NO: 1690 - protein, 17 aa, Artificial Sequence
  Description of Artificial Sequence: Synthetic peptide
  XENP019919 vhCDR2
FISYDGNNKYYADSVKG

SEQ ID NO: 1691 - protein, 9 aa, Artificial Sequence
  Description of Artificial Sequence: Synthetic peptide
  XENP019919 vhCDR3
TGWLGPFDY

SEQ ID NO: 1692 - protein, 12 aa, Artificial Sequence
  Description of Artificial Sequence: Synthetic peptide
  XENP019919 vlCDR1
RASQSVGSNYLA

SEQ ID NO: 1693 - protein, 7 aa, Artificial Sequence
  Description of Artificial Sequence: Synthetic peptide
  XENP019919 vlCDR2
GAFSRAT

SEQ ID NO: 1694 - protein, 9 aa, Artificial Sequence
  Description of Artificial Sequence: Synthetic peptide
  XENP019919 vlCDR3
QQYGSSPWT

SEQ ID NO: 1695 - protein, 246 aa, Artificial Sequence
  Description of Artificial Sequence: Synthetic polypeptide
  XENP019920 [CTLA-4]_H0_L0.32_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSQYLAWYQQKPGQAPRLLIYGAFSRATGIPDRFSGSGSGTDFTLTISRLEPEDFAVYYCQQYGSSPWTFGQGTKVEIK

SEQ ID NO: 1696 - protein, 118 aa, Artificial Sequence; identical to SEQ ID NO: 22
  Description of Artificial Sequence: Synthetic polypeptide
  VH of XENP019920

SEQ ID NO: 1697 - protein, 108 aa, Artificial Sequence
  Description of Artificial Sequence: Synthetic polypeptide
  VL of XENP019920
EIVLTQSPGTLSLSPGERATLSCRASQSVGSQYLAWYQQKPGQAPRLLIYGAFSRATGIPDRFSGSGSGTDFTLTISRLEPEDFAVYYCQQYGSSPWTFGQGTKVEIK

SEQ ID NO: 1698 - protein, 5 aa, Artificial Sequence
  Description of Artificial Sequence: Synthetic peptide
  XENP019920 vhCDR1
SYTMH

SEQ ID NO: 1699 - protein, 17 aa, Artificial Sequence
  Description of Artificial Sequence: Synthetic peptide
  XENP019920 vhCDR2
FISYDGNNKYYADSVKG

SEQ ID NO: 1700 - protein, 9 aa, Artificial Sequence
  Description of Artificial Sequence: Synthetic peptide
  XENP019920 vhCDR3
TGWLGPFDY

SEQ ID NO: 1701 - protein, 12 aa, Artificial Sequence
  Description of Artificial Sequence: Synthetic peptide
  XENP019920 vlCDR1
RASQSVGSQYLA

SEQ ID NO: 1702 - protein, 7 aa, Artificial Sequence
  Description of Artificial Sequence: Synthetic peptide
  XENP019920 vlCDR2
GAFSRAT

SEQ ID NO: 1703 - protein, 9 aa, Artificial Sequence
  Description of Artificial Sequence: Synthetic peptide
  XENP019920 vlCDR3
QQYGSSPWT

SEQ ID NO: 1704 - protein, 246 aa, Artificial Sequence
  Description of Artificial Sequence: Synthetic polypeptide
  XENP019921 [CTLA-4]_H0_L0.33_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSTYLAWYQQKPGQAPRLLIYGAFSRATGIPDRFSGSGSGTDFTLTISRLEPEDFAVYYCQQYGSSPWTFGQGTKVEIK

SEQ ID NO: 1705 - protein, 118 aa, Artificial Sequence; identical to SEQ ID NO: 22
  Description of Artificial Sequence: Synthetic polypeptide
  VH of XENP019921

SEQ ID NO: 1706 - protein, 108 aa, Artificial Sequence
  Description of Artificial Sequence: Synthetic polypeptide
  VL of XENP019921
EIVLTQSPGTLSLSPGERATLSCRASQSVGSTYLAWYQQKPGQAPRLLIYGAFSRATGIPDRFSGSGSGTDFTLTISRLEPEDFAVYYCQQYGSSPWTFGQGTKVEIK

SEQ ID NO: 1707 - protein, 5 aa, Artificial Sequence
  Description of Artificial Sequence: Synthetic peptide
  XENP019921 vhCDR1
SYTMH

SEQ ID NO: 1708 - protein, 17 aa, Artificial Sequence
  Description of Artificial Sequence: Synthetic peptide
  XENP019921 vhCDR2
FISYDGNNKYYADSVKG

SEQ ID NO: 1709 - protein, 9 aa, Artificial Sequence
  Description of Artificial Sequence: Synthetic peptide
  XENP019921 vhCDR3
TGWLGPFDY

SEQ ID NO: 1710 - protein, 12 aa, Artificial Sequence
  Description of Artificial Sequence: Synthetic peptide
  XENP019921 vlCDR1
RASQSVGSTYLA

SEQ ID NO: 1711 - protein, 7 aa, Artificial Sequence
  Description of Artificial Sequence: Synthetic peptide
  XENP019921 vlCDR2
GAFSRAT

SEQ ID NO: 1712 - protein, 9 aa, Artificial Sequence
  Description of Artificial Sequence: Synthetic peptide
  XENP019921 vlCDR3
QQYGSSPWT

SEQ ID NO: 1713 - protein, 246 aa, Artificial Sequence
  Description of Artificial Sequence: Synthetic polypeptide
  XENP019922 [CTLA-4]_H0_L0.34_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSALAWYQQKPGQAPRLLIYGAFSRATGIPDRFSGSGSGTDFTLTISRLEPEDFAVYYCQQYGSSPWTFGQGTKVEIK

SEQ ID NO: 1714 - protein, 118 aa, Artificial Sequence; identical to SEQ ID NO: 22
  Description of Artificial Sequence: Synthetic polypeptide
  VH of XENP019922

SEQ ID NO: 1715 - protein, 108 aa, Artificial Sequence
  Description of Artificial Sequence: Synthetic polypeptide
  VL of XENP019922
EIVLTQSPGTLSLSPGERATLSCRASQSVGSSALAWYQQKPGQAPRLLIYGAFSRATGIPDRFSGSGSGTDFTLTISRLEPEDFAVYYCQQYGSSPWTFGQGTKVEIK

SEQ ID NO: 1716 - protein, 5 aa, Artificial Sequence
  Description of Artificial Sequence: Synthetic peptide
  XENP019922 vhCDR1
SYTMH

SEQ ID NO: 1717 - protein, 17 aa, Artificial Sequence
  Description of Artificial Sequence: Synthetic peptide
  XENP019922 vhCDR2
FISYDGNNKYYADSVKG

SEQ ID NO: 1718 - protein, 9 aa, Artificial Sequence
  Description of Artificial Sequence: Synthetic peptide
  XENP019922 vhCDR3
TGWLGPFDY

SEQ ID NO: 1719 - protein, 12 aa, Artificial Sequence
  Description of Artificial Sequence: Synthetic peptide
  XENP019922 vlCDR1
RASQSVGSSALA

SEQ ID NO: 1720 - protein, 7 aa, Artificial Sequence
  Description of Artificial Sequence: Synthetic peptide
  XENP019922 vlCDR2
GAFSRAT

SEQ ID NO: 1721 - protein, 9 aa, Artificial Sequence
  Description of Artificial Sequence: Synthetic peptide
  XENP019922 vlCDR3
QQYGSSPWT

SEQ ID NO: 1722 - protein, 246 aa, Artificial Sequence
  Description of Artificial Sequence: Synthetic polypeptide
  XENP019923 [CTLA-4]_H0_L0.35_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSFLAWYQQKPGQAPRLLIYGAFSRATGIPDRFSGSGSGTDFTLTISRLEPEDFAVYYCQQYGSSPWTFGQGTKVEIK

SEQ ID NO: 1723 - protein, 118 aa, Artificial Sequence; identical to SEQ ID NO: 22
  Description of Artificial Sequence: Synthetic polypeptide
  VH of XENP019923

SEQ ID NO: 1724 - protein, 108 aa, Artificial Sequence
  Description of Artificial Sequence: Synthetic polypeptide
  VL of XENP019923
EIVLTQSPGTLSLSPGERATLSCRASQSVGSSFLAWYQQKPGQAPRLLIYGAFSRATGIPDRFSGSGSGTDFTLTISRLEPEDFAVYYCQQYGSSPWTFGQGTKVEIK

SEQ ID NO: 1725 - protein, 5 aa, Artificial Sequence
  Description of Artificial Sequence: Synthetic peptide
  XENP019923 vhCDR1
SYTMH

SEQ ID NO: 1726 - protein, 17 aa, Artificial Sequence
  Description of Artificial Sequence: Synthetic peptide
  XENP019923 vhCDR2
FISYDGNNKYYADSVKG

SEQ ID NO: 1727 - protein, 9 aa, Artificial Sequence
  Description of Artificial Sequence: Synthetic peptide
  XENP019923 vhCDR3
TGWLGPFDY

SEQ ID NO: 1728 - protein, 12 aa, Artificial Sequence
  Description of Artificial Sequence: Synthetic peptide
  XENP019923 vlCDR1
RASQSVGSSFLA

SEQ ID NO: 1729 - protein, 7 aa, Artificial Sequence
  Description of Artificial Sequence: Synthetic peptide
  XENP019923 vlCDR2
GAFSRAT

SEQ ID NO: 1730 - protein, 9 aa, Artificial Sequence
  Description of Artificial Sequence: Synthetic peptide
  XENP019923 vlCDR3
QQYGSSPWT

SEQ ID NO: 1731 - protein, 246 aa, Artificial Sequence
  Description of Artificial Sequence: Synthetic polypeptide
  XENP019924 [CTLA-4]_H0_L0.36_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSHLAWYQQKPGQAPRLLIYGAFSRATGIPDRFSGSGSGTDFTLTISRLEPEDFAVYYCQQYGSSPWTFGQGTKVEIK

SEQ ID NO: 1732 - protein, 118 aa, Artificial Sequence; identical to SEQ ID NO: 22
  Description of Artificial Sequence: Synthetic polypeptide
  VH of XENP019924

SEQ ID NO: 1733 - protein, 108 aa, Artificial Sequence
  Description of Artificial Sequence: Synthetic polypeptide
  VL of XENP019924
EIVLTQSPGTLSLSPGERATLSCRASQSVGSSHLAWYQQKPGQAPRLLIYGAFSRATGIPDRFSGSGSGTDFTLTISRLEPEDFAVYYCQQYGSSPWTFGQGTKVEIK

SEQ ID NO: 1734 - protein, 5 aa, Artificial Sequence
  Description of Artificial Sequence: Synthetic peptide
  XENP019924 vhCDR1
SYTMH

SEQ ID NO: 1735 - protein, 17 aa, Artificial Sequence
  Description of Artificial Sequence: Synthetic peptide
  XENP019924 vhCDR2
FISYDGNNKYYADSVKG

SEQ ID NO: 1736 - protein, 9 aa, Artificial Sequence
  Description of Artificial Sequence: Synthetic peptide
  XENP019924 vhCDR3
TGWLGPFDY

SEQ ID NO: 1737 - protein, 12 aa, Artificial Sequence
  Description of Artificial Sequence: Synthetic peptide
  XENP019924 vlCDR1
RASQSVGSSHLA

SEQ ID NO: 1738 - protein, 7 aa, Artificial Sequence
  Description of Artificial Sequence: Synthetic peptide
  XENP019924 vlCDR2
GAFSRAT

SEQ ID NO: 1739 - protein, 9 aa, Artificial Sequence
  Description of Artificial Sequence: Synthetic peptide
  XENP019924 vlCDR3
QQYGSSPWT

SEQ ID NO: 1740 - protein, 246 aa, Artificial Sequence
  Description of Artificial Sequence: Synthetic polypeptide
  XENP019925 [CTLA-4]_H0_L0.37_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSLLAWYQQKPGQAPRLLIYGAFSRATGIPDRFSGSGSGTDFTLTISRLEPEDFAVYYCQQYGSSPWTFGQGTKVEIK

SEQ ID NO: 1741 - protein, 118 aa, Artificial Sequence; identical to SEQ ID NO: 22
  Description of Artificial Sequence: Synthetic polypeptide
  VH of XENP019925

SEQ ID NO: 1742 - protein, 108 aa, Artificial Sequence
  Description of Artificial Sequence: Synthetic polypeptide
  VL of XENP019925
EIVLTQSPGTLSLSPGERATLSCRASQSVGSSLLAWYQQKPGQAPRLLIYGAFSRATGIPDRFSGSGSGTDFTLTISRLEPEDFAVYYCQQYGSSPWTFGQGTKVEIK

SEQ ID NO: 1743 - protein, 5 aa, Artificial Sequence
  Description of Artificial Sequence: Synthetic peptide
  XENP019925 vhCDR1
SYTMH

SEQ ID NO: 1744 - protein, 17 aa, Artificial Sequence
  Description of Artificial Sequence: Synthetic peptide
  XENP019925 vhCDR2
FISYDGNNKYYADSVKG

SEQ ID NO: 1745 - protein, 9 aa, Artificial Sequence
  Description of Artificial Sequence: Synthetic peptide
  XENP019925 vhCDR3
TGWLGPFDY

SEQ ID NO: 1746 - protein, 12 aa, Artificial Sequence
  Description of Artificial Sequence: Synthetic peptide
  XENP019925 vlCDR1
RASQSVGSSLLA

SEQ ID NO: 1747 - protein, 7 aa, Artificial Sequence
  Description of Artificial Sequence: Synthetic peptide
  XENP019925 vlCDR2
GAFSRAT

SEQ ID NO: 1748 - protein, 9 aa, Artificial Sequence
  Description of Artificial Sequence: Synthetic peptide
  XENP019925 vlCDR3
QQYGSSPWT

SEQ ID NO: 1749 - protein, 246 aa, Artificial Sequence
  Description of Artificial Sequence: Synthetic polypeptide
  XENP019926 [CTLA-4]_H0_L0.38_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSNLAWYQQKPGQAPRLLIYGAFSRATGIPDRFSGSGSGTDFTLTISRLEPEDFAVYYCQQYGSSPWTFGQGTKVEIK

SEQ ID NO: 1750 - protein, 118 aa, Artificial Sequence; identical to SEQ ID NO: 22
  Description of Artificial Sequence: Synthetic polypeptide
  VH of XENP019926

SEQ ID NO: 1751 - protein, 108 aa, Artificial Sequence
  Description of Artificial Sequence: Synthetic polypeptide
  VL of XENP019926
EIVLTQSPGTLSLSPGERATLSCRASQSVGSSNLAWYQQKPGQAPRLLIYGAFSRATGIPDRFSGSGSGTDFTLTISRLEPEDFAVYYCQQYGSSPWTFGQGTKVEIK

SEQ ID NO: 1752 - protein, 5 aa, Artificial Sequence
  Description of Artificial Sequence: Synthetic peptide
  XENP019926 vhCDR1
SYTMH

SEQ ID NO: 1753 - protein, 17 aa, Artificial Sequence
  Description of Artificial Sequence: Synthetic peptide
  XENP019926 vhCDR2
FISYDGNNKYYADSVKG

SEQ ID NO: 1754 - protein, 9 aa, Artificial Sequence
  Description of Artificial Sequence: Synthetic peptide
  XENP019926 vhCDR3
TGWLGPFDY

SEQ ID NO: 1755 - protein, 12 aa, Artificial Sequence
  Description of Artificial Sequence: Synthetic peptide
  XENP019926 vlCDR1
RASQSVGSSNLA

SEQ ID NO: 1756 - protein, 7 aa, Artificial Sequence
  Description of Artificial Sequence: Synthetic peptide
  XENP019926 vlCDR2
GAFSRAT

SEQ ID NO: 1757 - protein, 9 aa, Artificial Sequence
  Description of Artificial Sequence: Synthetic peptide
  XENP019926 vlCDR3
QQYGSSPWT

SEQ ID NO: 1758 - protein, 246 aa, Artificial Sequence
  Description of Artificial Sequence: Synthetic polypeptide
  XENP019927 [CTLA-4]_H0_L0.39_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSSLAWYQQKPGQAPRLLIYGAFSRATGIPDRFSGSGSGTDFTLTISRLEPEDFAVYYCQQYGSSPWTFGQGTKVEIK

SEQ ID NO: 1759 - protein, 118 aa, Artificial Sequence; identical to SEQ ID NO: 22
  Description of Artificial Sequence: Synthetic polypeptide
  VH of XENP019927

SEQ ID NO: 1760 - protein, 108 aa, Artificial Sequence
  Description of Artificial Sequence: Synthetic polypeptide
  VL of XENP019927
EIVLTQSPGTLSLSPGERATLSCRASQSVGSSSLAWYQQKPGQAPRLLIYGAFSRATGIPDRFSGSGSGTDFTLTISRLEPEDFAVYYCQQYGSSPWTFGQGTKVEIK

SEQ ID NO: 1761 - protein, 5 aa, Artificial Sequence
  Description of Artificial Sequence: Synthetic peptide
  XENP019927 vhCDR1
SYTMH

SEQ ID NO: 1762 - protein, 17 aa, Artificial Sequence
  Description of Artificial Sequence: Synthetic peptide
  XENP019927 vhCDR2
FISYDGNNKYYADSVKG

SEQ ID NO: 1763 - protein, 9 aa, Artificial Sequence
  Description of Artificial Sequence: Synthetic peptide
  XENP019927 vhCDR3
TGWLGPFDY

SEQ ID NO: 1764 - protein, 12 aa, Artificial Sequence
  Description of Artificial Sequence: Synthetic peptide
  XENP019927 vlCDR1
RASQSVGSSSLA

SEQ ID NO: 1765 - protein, 7 aa, Artificial Sequence
  Description of Artificial Sequence: Synthetic peptide
  XENP019927 vlCDR2
GAFSRAT

SEQ ID NO: 1766 - protein, 9 aa, Artificial Sequence
  Description of Artificial Sequence: Synthetic peptide
  XENP019927 vlCDR3
QQYGSSPWT

SEQ ID NO: 1767 - protein, 246 aa, Artificial Sequence
  Description of Artificial Sequence: Synthetic polypeptide
  XENP019928 [CTLA-4]_H0_L0.40_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSVLAWYQQKPGQAPRLLIYGAFSRATGIPDRFSGSGSGTDFTLTISRLEPEDFAVYYCQQYGSSPWTFGQGTKVEIK

SEQ ID NO: 1768 - protein, 118 aa, Artificial Sequence; identical to SEQ ID NO: 22
  Description of Artificial Sequence: Synthetic polypeptide
  VH of XENP019928

SEQ ID NO: 1769 - protein, 108 aa, Artificial Sequence
  Description of Artificial Sequence: Synthetic polypeptide
  VL of XENP019928
EIVLTQSPGTLSLSPGERATLSCRASQSVGSSVLAWYQQKPGQAPRLLIYGAFSRATGIPDRFSGSGSGTDFTLTISRLEPEDFAVYYCQQYGSSPWTFGQGTKVEIK

SEQ ID NO: 1770 - protein, 5 aa, Artificial Sequence
  Description of Artificial Sequence: Synthetic peptide
  XENP019928 vhCDR1
SYTMH

SEQ ID NO: 1771 - protein, 17 aa, Artificial Sequence
  Description of Artificial Sequence: Synthetic peptide
  XENP019928 vhCDR2
FISYDGNNKYYADSVKG

SEQ ID NO: 1772 - protein, 9 aa, Artificial Sequence
  Description of Artificial Sequence: Synthetic peptide
  XENP019928 vhCDR3
TGWLGPFDY

SEQ ID NO: 1773 - protein, 12 aa, Artificial Sequence
  Description of Artificial Sequence: Synthetic peptide
  XENP019928 vlCDR1
RASQSVGSSVLA

SEQ ID NO: 1774 - protein, 7 aa, Artificial Sequence
  Description of Artificial Sequence: Synthetic peptide
  XENP019928 vlCDR2
GAFSRAT

SEQ ID NO: 1775 - protein, 9 aa, Artificial Sequence
  Description of Artificial Sequence: Synthetic peptide
  XENP019928 vlCDR3
QQYGSSPWT

SEQ ID NO: 1776 - protein, 246 aa, Artificial Sequence
  Description of Artificial Sequence: Synthetic polypeptide
  XENP019929 [CTLA-4]_H0_L0.41_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYMAWYQQKPGQAPRLLIYGAFSRATGIPDRFSGSGSGTDFTLTISRLEPEDFAVYYCQQYGSSPWTFGQGTKVEIK

SEQ ID NO: 1777 - protein, 118 aa, Artificial Sequence; identical to SEQ ID NO: 22
  Description of Artificial Sequence: Synthetic polypeptide
  VH of XENP019929

SEQ ID NO: 1778 - protein, 108 aa, Artificial Sequence
  Description of Artificial Sequence: Synthetic polypeptide
  VL of XENP019929
EIVLTQSPGTLSLSPGERATLSCRASQSVGSSYMAWYQQKPGQAPRLLIYGAFSRATGIPDRFSGSGSGTDFTLTISRLEPEDFAVYYCQQYGSSPWTFGQGTKVEIK

SEQ ID NO: 1779 - protein, 5 aa, Artificial Sequence
  Description of Artificial Sequence: Synthetic peptide
  XENP019929 vhCDR1
SYTMH

SEQ ID NO: 1780 - protein, 17 aa, Artificial Sequence
  Description of Artificial Sequence: Synthetic peptide
  XENP019929 vhCDR2
FISYDGNNKYYADSVKG

SEQ ID NO: 1781 - protein, 9 aa, Artificial Sequence
  Description of Artificial Sequence: Synthetic peptide
  XENP019929 vhCDR3
TGWLGPFDY

SEQ ID NO: 1782 - protein, 12 aa, Artificial Sequence
  Description of Artificial Sequence: Synthetic peptide
  XENP019929 vlCDR1
RASQSVGSSYMA

SEQ ID NO: 1783 - protein, 7 aa, Artificial Sequence
  Description of Artificial Sequence: Synthetic peptide
  XENP019929 vlCDR2
GAFSRAT

SEQ ID NO: 1784 - protein, 9 aa, Artificial Sequence
  Description of Artificial Sequence: Synthetic peptide
  XENP019929 vlCDR3
QQYGSSPWT

SEQ ID NO: 1785 - protein, 246 aa, Artificial Sequence
  Description of Artificial Sequence: Synthetic polypeptide
  XENP019930 [CTLA-4]_H0_L0.42_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLDWYQQKPGQAPRLLIYGAFSRATGIPDRFSGSGSGTDFTLTISRLEPEDFAVYYCQQYGSSPWTFGQGTKVEIK

SEQ ID NO: 1786 - protein, 118 aa, Artificial Sequence; identical to SEQ ID NO: 22
  Description of Artificial Sequence: Synthetic polypeptide
  VH of XENP019930

SEQ ID NO: 1787 - protein, 108 aa, Artificial Sequence
  Description of Artificial Sequence: Synthetic polypeptide
  VL of XENP019930
EIVLTQSPGTLSLSPGERATLSCRASQSVGSSYLDWYQQKPGQAPRLLIYGAFSRATGIPDRFSGSGSGTDFTLTISRLEPEDFAVYYCQQYGSSPWTFGQGTKVEIK

SEQ ID NO: 1788 - protein, 5 aa, Artificial Sequence
  Description of Artificial Sequence: Synthetic peptide
  XENP019930 vhCDR1
SYTMH

SEQ ID NO: 1789 - protein, 17 aa, Artificial Sequence
  Description of Artificial Sequence: Synthetic peptide
  XENP019930 vhCDR2
FISYDGNNKYYADSVKG

SEQ ID NO: 1790 - protein, 9 aa, Artificial Sequence
  Description of Artificial Sequence: Synthetic peptide
  XENP019930 vhCDR3
TGWLGPFDY

SEQ ID NO: 1791 - protein, 12 aa, Artificial Sequence
  Description of Artificial Sequence: Synthetic peptide
  XENP019930 vlCDR1
RASQSVGSSYLD

SEQ ID NO: 1792 - protein, 7 aa, Artificial Sequence
  Description of Artificial Sequence: Synthetic peptide
  XENP019930 vlCDR2
GAFSRAT

SEQ ID NO: 1793 - protein, 9 aa, Artificial Sequence
  Description of Artificial Sequence: Synthetic peptide
  XENP019930 vlCDR3
QQYGSSPWT

SEQ ID NO: 1794 - protein, 246 aa, Artificial Sequence
  Description of Artificial Sequence: Synthetic polypeptide
  XENP019931 [CTLA-4]_H0_L0.43_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLDWYQQKPGQAPRLLIYGAFSRATGIPDRFSGSGSGTDFTLTISRLEPEDFAVYYCKQYGSSPWTFGQGTKVEIK

SEQ ID NO: 1795 - protein, 118 aa, Artificial Sequence; identical to SEQ ID NO: 22
  Description of Artificial Sequence: Synthetic polypeptide
  VH of XENP019931

SEQ ID NO: 1796 - protein, 108 aa, Artificial Sequence
  Description of Artificial Sequence: Synthetic polypeptide
  VL of XENP019931
EIVLTQSPGTLSLSPGERATLSCRASQSVGSSYLDWYQQKPGQAPRLLIYGAFSRATGIPDRFSGSGSGTDFTLTISRLEPEDFAVYYCKQYGSSPWTFGQGTKVEIK

SEQ ID NO: 1797 - protein, 5 aa, Artificial Sequence
  Description of Artificial Sequence: Synthetic peptide
  XENP019931 vhCDR1
SYTMH

SEQ ID NO: 1798 - protein, 17 aa, Artificial Sequence
  Description of Artificial Sequence: Synthetic peptide
  XENP019931 vhCDR2
FISYDGNNKYYADSVKG

SEQ ID NO: 1799 - protein, 9 aa, Artificial Sequence
  Description of Artificial Sequence: Synthetic peptide
  XENP019931 vhCDR3
TGWLGPFDY

SEQ ID NO: 1800 - protein, 12 aa, Artificial Sequence
  Description of Artificial Sequence: Synthetic peptide
  XENP019931 vlCDR1
RASQSVGSSYLD

SEQ ID NO: 1801 - protein, 7 aa, Artificial Sequence
  Description of Artificial Sequence: Synthetic peptide
  XENP019931 vlCDR2
GAFSRAT

SEQ ID NO: 1802 - protein, 9 aa, Artificial Sequence
  Description of Artificial Sequence: Synthetic peptide
  XENP019931 vlCDR3
KQYGSSPWT

SEQ ID NO: 1803 - protein, 246 aa, Artificial Sequence
  Description of Artificial Sequence: Synthetic polypeptide
  XENP019932 [CTLA-4]_H0_L0.44_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLSWYQQKPGQAPRLLIYGAFSRATGIPDRFSGSGSGTDFTLTISRLEPEDFAVYYCQQYGSSPWTFGQGTKVEIK

SEQ ID NO: 1804 - protein, 118 aa, Artificial Sequence; identical to SEQ ID NO: 22
  Description of Artificial Sequence: Synthetic polypeptide
  VH of XENP019932

SEQ ID NO: 1805 - protein, 108 aa, Artificial Sequence
  Description of Artificial Sequence: Synthetic polypeptide
  VL of XENP019932
EIVLTQSPGTLSLSPGERATLSCRASQSVGSSYLSWYQQKPGQAPRLLIYGAFSRATGIPDRFSGSGSGTDFTLTISRLEPEDFAVYYCQQYGSSPWTFGQGTKVEIK

SEQ ID NO: 1806 - protein, 5 aa, Artificial Sequence
  Description of Artificial Sequence: Synthetic peptide
  XENP019932 vhCDR1
SYTMH

SEQ ID NO: 1807 - protein, 17 aa, Artificial Sequence
  Description of Artificial Sequence: Synthetic peptide
  XENP019932 vhCDR2
FISYDGNNKYYADSVKG

SEQ ID NO: 1808 - protein, 9 aa, Artificial Sequence
  Description of Artificial Sequence: Synthetic peptide
  XENP019932 vhCDR3
TGWLGPFDY

SEQ ID NO: 1809 - protein, 12 aa, Artificial Sequence
  Description of Artificial Sequence: Synthetic peptide
  XENP019932 vlCDR1
RASQSVGSSYLS

SEQ ID NO: 1810 - protein, 7 aa, Artificial Sequence
  Description of Artificial Sequence: Synthetic peptide
  XENP019932 vlCDR2
GAFSRAT

SEQ ID NO: 1811 - protein, 9 aa, Artificial Sequence
  Description of Artificial Sequence: Synthetic peptide
  XENP019932 vlCDR3
QQYGSSPWT

SEQ ID NO: 1812 - protein, 246 aa, Artificial Sequence
  Description of Artificial Sequence: Synthetic polypeptide
  XENP019933 [CTLA-4]_H0_L0.45_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLTWYQQKPGQAPRLLIYGAFSRATGIPDRFSGSGSGTDFTLTISRLEPEDFAVYYCQQYGSSPWTFGQGTKVEIK

SEQ ID NO: 1813 - protein, 118 aa, Artificial Sequence; identical to SEQ ID NO: 22
  Description of Artificial Sequence: Synthetic polypeptide
  VH of XENP019933

SEQ ID NO: 1814 - protein, 108 aa, Artificial Sequence
  Description of Artificial Sequence: Synthetic polypeptide
  VL of XENP019933
EIVLTQSPGTLSLSPGERATLSCRASQSVGSSYLTWYQQKPGQAPRLLIYGAFSRATGIPDRFSGSGSGTDFTLTISRLEPEDFAVYYCQQYGSSPWTFGQGTKVEIK

SEQ ID NO: 1815 - protein, 5 aa, Artificial Sequence
  Description of Artificial Sequence: Synthetic peptide
  XENP019933 vhCDR1
SYTMH

SEQ ID NO: 1816 - protein, 17 aa, Artificial Sequence
  Description of Artificial Sequence: Synthetic peptide
  XENP019933 vhCDR2
FISYDGNNKYYADSVKG

SEQ ID NO: 1817 - protein, 9 aa, Artificial Sequence
  Description of Artificial Sequence: Synthetic peptide
  XENP019933 vhCDR3
TGWLGPFDY

SEQ ID NO: 1818 - protein, 12 aa, Artificial Sequence
  Description of Artificial Sequence: Synthetic peptide
  XENP019933 vlCDR1
RASQSVGSSYLT

SEQ ID NO: 1819 - protein, 7 aa, Artificial Sequence
  Description of Artificial Sequence: Synthetic peptide
  XENP019933 vlCDR2
GAFSRAT

SEQ ID NO: 1820 - protein, 9 aa, Artificial Sequence
  Description of Artificial Sequence: Synthetic peptide
  XENP019933 vlCDR3
QQYGSSPWT

SEQ ID NO: 1821 - protein, 246 aa, Artificial Sequence
  Description of Artificial Sequence: Synthetic polypeptide
  XENP019934 [CTLA-4]_H0_L0.46_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYEQKPGQAPRLLIYGAFSRATGIPDRFSGSGSGTDFTLTISRLEPEDFAVYYCQQYGSSPWTFGQGTKVEIK

SEQ ID NO: 1822 - protein, 118 aa, Artificial Sequence; identical to SEQ ID NO: 22
  Description of Artificial Sequence: Synthetic polypeptide
  VH of XENP019934

SEQ ID NO: 1823 - protein, 108 aa, Artificial Sequence
  Description of Artificial Sequence: Synthetic polypeptide
  VL of XENP019934
EIVLTQSPGTLSLSPGERATLSCRASQSVGSSYLAWYEQKPGQAPRLLIYGAFSRATGIPDRFSGSGSGTDFTLTISRLEPEDFAVYYCQQYGSSPWTFGQGTKVEIK

SEQ ID NO: 1824 - protein, 5 aa, Artificial Sequence
  Description of Artificial Sequence: Synthetic peptide
  XENP019934 vhCDR1
SYTMH

SEQ ID NO: 1825 - protein, 17 aa, Artificial Sequence
  Description of Artificial Sequence: Synthetic peptide
  XENP019934 vhCDR2
FISYDGNNKYYADSVKG

SEQ ID NO: 1826 - protein, 9 aa, Artificial Sequence
  Description of Artificial Sequence: Synthetic peptide
  XENP019934 vhCDR3
TGWLGPFDY

SEQ ID NO: 1827 - protein, 12 aa, Artificial Sequence
  Description of Artificial Sequence: Synthetic peptide
  XENP019934 vlCDR1
RASQSVGSSYLA

SEQ ID NO: 1828 - protein, 7 aa, Artificial Sequence
  Description of Artificial Sequence: Synthetic peptide
  XENP019934 vlCDR2
GAFSRAT

SEQ ID NO: 1829 - protein, 9 aa, Artificial Sequence
  Description of Artificial Sequence: Synthetic peptide
  XENP019934 vlCDR3
QQYGSSPWT

SEQ ID NO: 1830 - protein, 246 aa, Artificial Sequence
  Description of Artificial Sequence: Synthetic polypeptide
  XENP019935 [CTLA-4]_H0_L0.47_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYLQKPGQAPRLLIYGAFSRATGIPDRFSGSGSGTDFTLTISRLEPEDFAVYYCQQYGSSPWTFGQGTKVEIK

SEQ ID NO: 1831 - protein, 118 aa, Artificial Sequence; identical to SEQ ID NO: 22
  Description of Artificial Sequence: Synthetic polypeptide
  VH of XENP019935

SEQ ID NO: 1832 - protein, 108 aa, Artificial Sequence
  Description of Artificial Sequence: Synthetic polypeptide
  VL of XENP019935
EIVLTQSPGTLSLSPGERATLSCRASQSVGSSYLAWYLQKPGQAPRLLIYGAFSRATGIPDRFSGSGSGTDFTLTISRLEPEDFAVYYCQQYGSSPWTFGQGTKVEIK

SEQ ID NO: 1833 - protein, 5 aa, Artificial Sequence
  Description of Artificial Sequence: Synthetic peptide
  XENP019935 vhCDR1
SYTMH

SEQ ID NO: 1834 - protein, 17 aa, Artificial Sequence
  Description of Artificial Sequence: Synthetic peptide
  XENP019935 vhCDR2
FISYDGNNKYYADSVKG

SEQ ID NO: 1835 - protein, 9 aa, Artificial Sequence
  Description of Artificial Sequence: Synthetic peptide
  XENP019935 vhCDR3
TGWLGPFDY

SEQ ID NO: 1836 - protein, 12 aa, Artificial Sequence
  Description of Artificial Sequence: Synthetic peptide
  XENP019935 vlCDR1
RASQSVGSSYLA

SEQ ID NO: 1837 - protein, 7 aa, Artificial Sequence
  Description of Artificial Sequence: Synthetic peptide
  XENP019935 vlCDR2
GAFSRAT

SEQ ID NO: 1838 - protein, 9 aa, Artificial Sequence
  Description of Artificial Sequence: Synthetic peptide
  XENP019935 vlCDR3
QQYGSSPWT

SEQ ID NO: 1839 - protein, 246 aa, Artificial Sequence
  Description of Artificial Sequence: Synthetic polypeptide
  XENP019936 [CTLA-4]_H0_L0.48_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYRQKPGQAPRLLIYGAFSRATGIPDRFSGSGSGTDFTLTISRLEPEDFAVYYCQQYGSSPWTFGQGTKVEIK

SEQ ID NO: 1840 - protein, 118 aa, Artificial Sequence; identical to SEQ ID NO: 22
  Description of Artificial Sequence: Synthetic polypeptide
  VH of XENP019936

SEQ ID NO: 1841 - protein, 108 aa, Artificial Sequence
  Description of Artificial Sequence: Synthetic polypeptide
  VL of XENP019936
EIVLTQSPGTLSLSPGERATLSCRASQSVGSSYLAWYRQKPGQAPRLLIYGAFSRATGIPDRFSGSGSGTDFTLTISRLEPEDFAVYYCQQYGSSPWTFGQGTKVEIK

SEQ ID NO: 1842 - protein, 5 aa, Artificial Sequence
  Description of Artificial Sequence: Synthetic peptide
  XENP019936 vhCDR1
SYTMH

SEQ ID NO: 1843 - protein, 17 aa, Artificial Sequence
  Description of Artificial Sequence: Synthetic peptide
  XENP019936 vhCDR2
FISYDGNNKYYADSVKG

SEQ ID NO: 1844 - protein, 9 aa, Artificial Sequence
  Description of Artificial Sequence: Synthetic peptide
  XENP019936 vhCDR3
TGWLGPFDY

SEQ ID NO: 1845 - protein, 12 aa, Artificial Sequence
  Description of Artificial Sequence: Synthetic peptide
  XENP019936 vlCDR1
RASQSVGSSYLA

SEQ ID NO: 1846 - protein, 7 aa, Artificial Sequence
  Description of Artificial Sequence: Synthetic peptide
  XENP019936 vlCDR2
GAFSRAT

SEQ ID NO: 1847 - protein, 9 aa, Artificial Sequence
  Description of Artificial Sequence: Synthetic peptide
  XENP019936 vlCDR3
QQYGSSPWT

SEQ ID NO: 1848 - protein, 246 aa, Artificial Sequence
  Description of Artificial Sequence: Synthetic polypeptide
  XENP019937 [CTLA-4]_H0_L0.49_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYRQKPGQAPELLIYGAFSRATGIPDRFSGSGSGTDFTLTISRLEPEDFAVYYCQQYGSSPWTFGQGTKVEIK

SEQ ID NO: 1849 - protein, 118 aa, Artificial Sequence; identical to SEQ ID NO: 22
  Description of Artificial Sequence: Synthetic polypeptide
  VH of XENP019937

SEQ ID NO: 1850 - protein, 108 aa, Artificial Sequence
  Description of Artificial Sequence: Synthetic polypeptide
  VL of XENP019937
EIVLTQSPGTLSLSPGERATLSCRASQSVGSSYLAWYRQKPGQAPELLIYGAFSRATGIPDRFSGSGSGTDFTLTISRLEPEDFAVYYCQQYGSSPWTFGQGTKVEIK

SEQ ID NO: 1851 - protein, 5 aa, Artificial Sequence
  Description of Artificial Sequence: Synthetic peptide
  XENP019937 vhCDR1
SYTMH

SEQ ID NO: 1852 - protein, 17 aa, Artificial Sequence
  Description of Artificial Sequence: Synthetic peptide
  XENP019937 vhCDR2
FISYDGNNKYYADSVKG

SEQ ID NO: 1853 - protein, 9 aa, Artificial Sequence
  Description of Artificial Sequence: Synthetic peptide
  XENP019937 vhCDR3
TGWLGPFDY

SEQ ID NO: 1854 - protein, 12 aa, Artificial Sequence
  Description of Artificial Sequence: Synthetic peptide
  XENP019937 vlCDR1
RASQSVGSSYLA

SEQ ID NO: 1855 - protein, 7 aa, Artificial Sequence
  Description of Artificial Sequence: Synthetic peptide
  XENP019937 vlCDR2
GAFSRAT

SEQ ID NO: 1856 - protein, 9 aa, Artificial Sequence
  Description of Artificial Sequence: Synthetic peptide
  XENP019937 vlCDR3
QQYGSSPWT

SEQ ID NO: 1857 - protein, 246 aa, Artificial Sequence
  Description of Artificial Sequence: Synthetic polypeptide
  XENP019938 [CTLA-4]_H0_L0.50_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQEKPGQAPRLLIYGAFSRATGIPDRFSGSGSGTDFTLTISRLEPEDFAVYYCQQYGSSPWTFGQGTKVEIK

SEQ ID NO: 1858 - protein, 118 aa, Artificial Sequence; identical to SEQ ID NO: 22
  Description of Artificial Sequence: Synthetic polypeptide
  VH of XENP019938

SEQ ID NO: 1859 - protein, 108 aa, Artificial Sequence; identical to SEQ ID NO: 32
  Description of Artificial Sequence: Synthetic polypeptide
  VL of XENP019938

SEQ ID NO: 1860 - protein, 5 aa, Artificial Sequence
  Description of Artificial Sequence: Synthetic peptide
  XENP019938 vhCDR1
SYTMH

SEQ ID NO: 1861 - protein, 17 aa, Artificial Sequence
  Description of Artificial Sequence: Synthetic peptide
  XENP019938 vhCDR2
FISYDGNNKYYADSVKG

SEQ ID NO: 1862 - protein, 9 aa, Artificial Sequence
  Description of Artificial Sequence: Synthetic peptide
  XENP019938 vhCDR3
TGWLGPFDY

SEQ ID NO: 1863 - protein, 12 aa, Artificial Sequence
  Description of Artificial Sequence: Synthetic peptide
  XENP019938 vlCDR1
RASQSVGSSYLA

SEQ ID NO: 1864 - protein, 7 aa, Artificial Sequence
  Description of Artificial Sequence: Synthetic peptide
  XENP019938 vlCDR2
GAFSRAT

SEQ ID NO: 1865 - protein, 9 aa, Artificial Sequence
  Description of Artificial Sequence: Synthetic peptide
  XENP019938 vlCDR3
QQYGSSPWT

SEQ ID NO: 1866 - protein, 246 aa, Artificial Sequence
  Description of Artificial Sequence: Synthetic polypeptide
  XENP019939 [CTLA-4]_H0_L0.51_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPDQAPRLLIYGAFSRATGIPDRFSGSGSGTDFTLTISRLEPEDFAVYYCQQYGSSPWTFGQGTKVEIK

SEQ ID NO: 1867 - protein, 118 aa, Artificial Sequence; identical to SEQ ID NO: 22
  Description of Artificial Sequence: Synthetic polypeptide
  VH of XENP019939

SEQ ID NO: 1868 - protein, 108 aa, Artificial Sequence; identical to SEQ ID NO: 41
  Description of Artificial Sequence: Synthetic polypeptide
  VL of XENP019939

SEQ ID NO: 1869 - protein, 5 aa, Artificial Sequence
  Description of Artificial Sequence: Synthetic peptide
  XENP019939 vhCDR1
SYTMH

SEQ ID NO: 1870 - protein, 17 aa, Artificial Sequence
  Description of Artificial Sequence: Synthetic peptide
  XENP019939 vhCDR2
FISYDGNNKYYADSVKG

SEQ ID NO: 1871 - protein, 9 aa, Artificial Sequence
  Description of Artificial Sequence: Synthetic peptide
  XENP019939 vhCDR3
TGWLGPFDY

SEQ ID NO: 1872 - protein, 12 aa, Artificial Sequence
  Description of Artificial Sequence: Synthetic peptide
  XENP019939 vlCDR1
RASQSVGSSYLA

SEQ ID NO: 1873 - protein, 7 aa, Artificial Sequence
  Description of Artificial Sequence: Synthetic peptide
  XENP019939 vlCDR2
GAFSRAT

SEQ ID NO: 1874 - protein, 9 aa, Artificial Sequence
  Description of Artificial Sequence: Synthetic peptide
  XENP019939 vlCDR3
QQYGSSPWT

SEQ ID NO: 1875 - protein, 246 aa, Artificial Sequence
  Description of Artificial Sequence: Synthetic polypeptide
  XENP019940 [CTLA-4]_H0_L0.52_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPEQAPRLLIYGAFSRATGIPDRFSGSGSGTDFTLTISRLEPEDFAVYYCQQYGSSPWTFGQGTKVEIK

SEQ ID NO: 1876 - protein, 118 aa, Artificial Sequence; identical to SEQ ID NO: 22
  Description of Artificial Sequence: Synthetic polypeptide
  VH of XENP019940

SEQ ID NO: 1877 - protein, 108 aa, Artificial Sequence
  Description of Artificial Sequence: Synthetic polypeptide
  VL of XENP019940
EIVLTQSPGTLSLSPGERATLSCRASQSVGSSYLAWYQQKPEQAPRLLIYGAFSRATGIPDRFSGSGSGTDFTLTISRLEPEDFAVYYCQQYGSSPWTFGQGTKVEIK

SEQ ID NO: 1878 - protein, 5 aa, Artificial Sequence
  Description of Artificial Sequence: Synthetic peptide
  XENP019940 vhCDR1
SYTMH

SEQ ID NO: 1879 - protein, 17 aa, Artificial Sequence
  Description of Artificial Sequence: Synthetic peptide
  XENP019940 vhCDR2
FISYDGNNKYYADSVKG

SEQ ID NO: 1880 - protein, 9 aa, Artificial Sequence
  Description of Artificial Sequence: Synthetic peptide
  XENP019940 vhCDR3
TGWLGPFDY

SEQ ID NO: 1881 - protein, 12 aa, Artificial Sequence
  Description of Artificial Sequence: Synthetic peptide
  XENP019940 vlCDR1
RASQSVGSSYLA

SEQ ID NO: 1882 - protein, 7 aa, Artificial Sequence
  Description of Artificial Sequence: Synthetic peptide
  XENP019940 vlCDR2
GAFSRAT

SEQ ID NO: 1883 - protein, 9 aa, Artificial Sequence
  Description of Artificial Sequence: Synthetic peptide
  XENP019940 vlCDR3
QQYGSSPWT

SEQ ID NO: 1884 - protein, 246 aa, Artificial Sequence
  Description of Artificial Sequence: Synthetic polypeptide
  XENP019941 [CTLA-4]_H0_L0.53_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGEAPRLLIYGAFSRATGIPDRFSGSGSGTDFTLTISRLEPEDFAVYYCQQYGSSPWTFGQGTKVEIK

SEQ ID NO: 1885 - protein, 118 aa, Artificial Sequence; identical to SEQ ID NO: 22
  Description of Artificial Sequence: Synthetic polypeptide
  VH of XENP019941

SEQ ID NO: 1886 - protein, 108 aa, Artificial Sequence; identical to SEQ ID NO: 77
  Description of Artificial Sequence: Synthetic polypeptide
  VL of XENP019941

SEQ ID NO: 1887 - protein, 5 aa, Artificial Sequence
  Description of Artificial Sequence: Synthetic peptide
  XENP019941 vhCDR1
SYTMH

SEQ ID NO: 1888 - protein, 17 aa, Artificial Sequence
  Description of Artificial Sequence: Synthetic peptide
  XENP019941 vhCDR2
FISYDGNNKYYADSVKG

SEQ ID NO: 1889 - protein, 9 aa, Artificial Sequence
  Description of Artificial Sequence: Synthetic peptide
  XENP019941 vhCDR3
TGWLGPFDY

SEQ ID NO: 1890 - protein, 12 aa, Artificial Sequence
  Description of Artificial Sequence: Synthetic peptide
  XENP019941 vlCDR1
RASQSVGSSYLA

SEQ ID NO: 1891 - protein, 7 aa, Artificial Sequence
  Description of Artificial Sequence: Synthetic peptide
  XENP019941 vlCDR2
GAFSRAT

SEQ ID NO: 1892 - protein, 9 aa, Artificial Sequence
  Description of Artificial Sequence: Synthetic peptide
  XENP019941 vlCDR3
QQYGSSPWT

SEQ ID NO: 1893 - protein, 246 aa, Artificial Sequence
  Description of Artificial Sequence: Synthetic polypeptide
  XENP019942 [CTLA-4]_H0_L0.54_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGKAPRLLIYGAFSRATGIPDRFSGSGSGTDFTLTISRLEPEDFAVYYCQQYGSSPWTFGQGTKVEIK

SEQ ID NO: 1894 - protein, 118 aa, Artificial Sequence; identical to SEQ ID NO: 22
  Description of Artificial Sequence: Synthetic polypeptide
  VH of XENP019942

SEQ ID NO: 1895 - protein, 108 aa, Artificial Sequence
  Description of Artificial Sequence: Synthetic polypeptide
  VL of XENP019942
EIVLTQSPGTLSLSPGERATLSCRASQSVGSSYLAWYQQKPGKAPRLLIYGAFSRATGIPDRFSGSGSGTDFTLTISRLEPEDFAVYYCQQYGSSPWTFGQGTKVEIK

SEQ ID NO: 1896 - protein, 5 aa, Artificial Sequence
  Description of Artificial Sequence: Synthetic peptide
  XENP019942 vhCDR1
SYTMH

SEQ ID NO: 1897 - protein, 17 aa, Artificial Sequence
  Description of Artificial Sequence: Synthetic peptide
  XENP019942 vhCDR2
FISYDGNNKYYADSVKG

SEQ ID NO: 1898 - protein, 9 aa, Artificial Sequence
  Description of Artificial Sequence: Synthetic peptide
  XENP019942 vhCDR3
TGWLGPFDY

SEQ ID NO: 1899 - protein, 12 aa, Artificial Sequence
  Description of Artificial Sequence: Synthetic peptide
  XENP019942 vlCDR1
RASQSVGSSYLA

SEQ ID NO: 1900 - protein, 7 aa, Artificial Sequence
  Description of Artificial Sequence: Synthetic peptide
  XENP019942 vlCDR2
GAFSRAT

SEQ ID NO: 1901 - protein, 9 aa, Artificial Sequence
  Description of Artificial Sequence: Synthetic peptide
  XENP019942 vlCDR3
QQYGSSPWT

SEQ ID NO: 1902 - protein, 246 aa, Artificial Sequence
  Description of Artificial Sequence: Synthetic polypeptide
  XENP019943 [CTLA-4]_H0_L0.55_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGKSPRLLIYGAFSRATGIPDRFSGSGSGTDFTLTISRLEPEDFAVYYCQQYGSSPWTFGQGTKVEIK

SEQ ID NO: 1903 - protein, 118 aa, Artificial Sequence; identical to SEQ ID NO: 22
  Description of Artificial Sequence: Synthetic polypeptide
  VH of XENP019943

SEQ ID NO: 1904 - protein, 108 aa, Artificial Sequence
  Description of Artificial Sequence: Synthetic polypeptide
  VL of XENP019943
EIVLTQSPGTLSLSPGERATLSCRASQSVGSSYLAWYQQKPGKSPRLLIYGAFSRATGIPDRFSGSGSGTDFTLTISRLEPEDFAVYYCQQYGSSPWTFGQGTKVEIK

SEQ ID NO: 1905 - protein, 5 aa, Artificial Sequence
  Description of Artificial Sequence: Synthetic peptide
  XENP019943 vhCDR1
SYTMH

SEQ ID NO: 1906 - protein, 17 aa, Artificial Sequence
  Description of Artificial Sequence: Synthetic peptide
  XENP019943 vhCDR2
FISYDGNNKYYADSVKG

SEQ ID NO: 1907 - protein, 9 aa, Artificial Sequence
  Description of Artificial Sequence: Synthetic peptide
  XENP019943 vhCDR3
TGWLGPFDY

SEQ ID NO: 1908 - protein, 12 aa, Artificial Sequence
  Description of Artificial Sequence: Synthetic peptide
  XENP019943 vlCDR1
RASQSVGSSYLA

SEQ ID NO: 1909 - protein, 7 aa, Artificial Sequence
  Description of Artificial Sequence: Synthetic peptide
  XENP019943 vlCDR2
GAFSRAT

SEQ ID NO: 1910 - protein, 9 aa, Artificial Sequence
  Description of Artificial Sequence: Synthetic peptide
  XENP019943 vlCDR3
QQYGSSPWT

SEQ ID NO: 1911 - protein, 246 aa, Artificial Sequence
  Description of Artificial Sequence: Synthetic polypeptide
  XENP019944 [CTLA-4]_H0_L0.56_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQSPRLLIYGAFSRATGIPDRFSGSGSGTDFTLTISRLEPEDFAVYYCQQYGSSPWTFGQGTKVEIK

SEQ ID NO: 1912 - protein, 118 aa, Artificial Sequence; identical to SEQ ID NO: 22
  Description of Artificial Sequence: Synthetic polypeptide
  VH of XENP019944

SEQ ID NO: 1913 - protein, 108 aa, Artificial Sequence
  Description of Artificial Sequence: Synthetic polypeptide
  VL of XENP019944
EIVLTQSPGTLSLSPGERATLSCRASQSVGSSYLAWYQQKPGQSPRLLIYGAFSRATGIPDRFSGSGSGTDFTLTISRLEPEDFAVYYCQQYGSSPWTFGQGTKVEIK

SEQ ID NO: 1914 - protein, 5 aa, Artificial Sequence
  Description of Artificial Sequence: Synthetic peptide
  XENP019944 vhCDR1
SYTMH

SEQ ID NO: 1915 - protein, 17 aa, Artificial Sequence
  Description of Artificial Sequence: Synthetic peptide
  XENP019944 vhCDR2
FISYDGNNKYYADSVKG

SEQ ID NO: 1916 - protein, 9 aa, Artificial Sequence
  Description of Artificial Sequence: Synthetic peptide
  XENP019944 vhCDR3
TGWLGPFDY

SEQ ID NO: 1917 - protein, 12 aa, Artificial Sequence
  Description of Artificial Sequence: Synthetic peptide
  XENP019944 vlCDR1
RASQSVGSSYLA

SEQ ID NO: 1918 - protein, 7 aa, Artificial Sequence
  Description of Artificial Sequence: Synthetic peptide
  XENP019944 vlCDR2
GAFSRAT

SEQ ID NO: 1919 - protein, 9 aa, Artificial Sequence
  Description of Artificial Sequence: Synthetic peptide
  XENP019944 vlCDR3
QQYGSSPWT

SEQ ID NO: 1920 - protein, 246 aa, Artificial Sequence
  Description of Artificial Sequence: Synthetic polypeptide
  XENP019945 [CTLA-4]_H0_L0.57_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPELLIYGAFSRATGIPDRFSGSGSGTDFTLTISRLEPEDFAVYYCQQYGSSPWTFGQGTKVEIK

SEQ ID NO: 1921 - protein, 118 aa, Artificial Sequence; identical to SEQ ID NO: 22
  Description of Artificial Sequence: Synthetic polypeptide
  VH of XENP019945

SEQ ID NO: 1922 - protein, 108 aa, Artificial Sequence; identical to SEQ ID NO: 86
  Description of Artificial Sequence: Synthetic polypeptide
  VL of XENP019945

SEQ ID NO: 1923 - protein, 5 aa, Artificial Sequence
  Description of Artificial Sequence: Synthetic peptide
  XENP019945 vhCDR1
SYTMH

SEQ ID NO: 1924 - protein, 17 aa, Artificial Sequence
  Description of Artificial Sequence: Synthetic peptide
  XENP019945 vhCDR2
FISYDGNNKYYADSVKG

SEQ ID NO: 1925 - protein, 9 aa, Artificial Sequence
  Description of Artificial Sequence: Synthetic peptide
  XENP019945 vhCDR3
TGWLGPFDY

SEQ ID NO: 1926 - protein, 12 aa, Artificial Sequence
  Description of Artificial Sequence: Synthetic peptide
  XENP019945 vlCDR1
RASQSVGSSYLA

SEQ ID NO: 1927 - protein, 7 aa, Artificial Sequence
  Description of Artificial Sequence: Synthetic peptide
  XENP019945 vlCDR2
GAFSRAT

SEQ ID NO: 1928 - protein, 9 aa, Artificial Sequence
  Description of Artificial Sequence: Synthetic peptide
  XENP019945 vlCDR3
QQYGSSPWT

SEQ ID NO: 1929 - protein, 246 aa, Artificial Sequence
  Description of Artificial Sequence: Synthetic polypeptide
  XENP019946 [CTLA-4]_H0_L0.58_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPELLIYGAFSRATGIPDRFSGSGSGTDFTLTISRLEPQDFAVYYCQQYGSSPWTFGQGTKVEIK

SEQ ID NO: 1930 - protein, 118 aa, Artificial Sequence; identical to SEQ ID NO: 22
  Description of Artificial Sequence: Synthetic polypeptide
  VH of XENP019946

SEQ ID NO: 1931 - protein, 108 aa, Artificial Sequence
  Description of Artificial Sequence: Synthetic polypeptide
  VL of XENP019946
EIVLTQSPGTLSLSPGERATLSCRASQSVGSSYLAWYQQKPGQAPELLIYGAFSRATGIPDRFSGSGSGTDFTLTISRLEPQDFAVYYCQQYGSSPWTFGQGTKVEIK

SEQ ID NO: 1932 - protein, 5 aa, Artificial Sequence
  Description of Artificial Sequence: Synthetic peptide
  XENP019946 vhCDR1
SYTMH

SEQ ID NO: 1933 - protein, 17 aa, Artificial Sequence
  Description of Artificial Sequence: Synthetic peptide
  XENP019946 vhCDR2
FISYDGNNKYYADSVKG

SEQ ID NO: 1934 - protein, 9 aa, Artificial Sequence
  Description of Artificial Sequence: Synthetic peptide
  XENP019946 vhCDR3
TGWLGPFDY

SEQ ID NO: 1935 - protein, 12 aa, Artificial Sequence
  Description of Artificial Sequence: Synthetic peptide
  XENP019946 vlCDR1
RASQSVGSSYLA

SEQ ID NO: 1936 - protein, 7 aa, Artificial Sequence
  Description of Artificial Sequence: Synthetic peptide
  XENP019946 vlCDR2
GAFSRAT

SEQ ID NO: 1937 - protein, 9 aa, Artificial Sequence
  Description of Artificial Sequence: Synthetic peptide
  XENP019946 vlCDR3
QQYGSSPWT

SEQ ID NO: 1938 - protein, 246 aa, Artificial Sequence
  Description of Artificial Sequence: Synthetic polypeptide
  XENP019947 [CTLA-4]_H0_L0.59_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPKLLIYGAFSRATGIPDRFSGSGSGTDFTLTISRLEPEDFAVYYCQQYGSSPWTFGQGTKVEIK

SEQ ID NO: 1939 - protein, 118 aa, Artificial Sequence; identical to SEQ ID NO: 22
  Description of Artificial Sequence: Synthetic polypeptide
  VH of XENP019947

SEQ ID NO: 1940 - protein, 108 aa, Artificial Sequence
  Description of Artificial Sequence: Synthetic polypeptide
  VL of XENP019947
EIVLTQSPGTLSLSPGERATLSCRASQSVGSSYLAWYQQKPGQAPKLLIYGAFSRATGIPDRFSGSGSGTDFTLTISRLEPEDFAVYYCQQYGSSPWTFGQGTKVEIK

SEQ ID NO: 1941 - protein, 5 aa, Artificial Sequence
  Description of Artificial Sequence: Synthetic peptide
  XENP019947 vhCDR1
SYTMH

SEQ ID NO: 1942 - protein, 17 aa, Artificial Sequence
  Description of Artificial Sequence: Synthetic peptide
  XENP019947 vhCDR2
FISYDGNNKYYADSVKG

SEQ ID NO: 1943 - protein, 9 aa, Artificial Sequence
  Description of Artificial Sequence: Synthetic peptide
  XENP019947 vhCDR3
TGWLGPFDY

SEQ ID NO: 1944 - protein, 12 aa, Artificial Sequence
  Description of Artificial Sequence: Synthetic peptide
  XENP019947 vlCDR1
RASQSVGSSYLA

SEQ ID NO: 1945 - protein, 7 aa, Artificial Sequence
  Description of Artificial Sequence: Synthetic peptide
  XENP019947 vlCDR2
GAFSRAT

SEQ ID NO: 1946 - protein, 9 aa, Artificial Sequence
  Description of Artificial Sequence: Synthetic peptide
  XENP019947 vlCDR3
QQYGSSPWT

SEQ ID NO: 1947 - protein, 246 aa, Artificial Sequence
  Description of Artificial Sequence: Synthetic polypeptide
  XENP019948 [CTLA-4]_H0_L0.60_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRRLIYGAFSRATGIPDRFSGSGSGTDFTLTISRLEPEDFAVYYCQQYGSSPWTFGQGTKVEIK

SEQ ID NO: 1948 - protein, 118 aa, Artificial Sequence; identical to SEQ ID NO: 22
  Description of Artificial Sequence: Synthetic polypeptide
  VH of XENP019948

SEQ ID NO: 1949 - protein, 108 aa, Artificial Sequence
  Description of Artificial Sequence: Synthetic polypeptide
  VL of XENP019948
EIVLTQSPGTLSLSPGERATLSCRASQSVGSSYLAWYQQKPGQAPRRLIYGAFSRATGIPDRFSGSGSGTDFTLTISRLEPEDFAVYYCQQYGSSPWTFGQGTKVEIK

SEQ ID NO: 1950 - protein, 5 aa, Artificial Sequence
  Description of Artificial Sequence: Synthetic peptide
  XENP019948 vhCDR1
SYTMH

SEQ ID NO: 1951 - protein, 17 aa, Artificial Sequence
  Description of Artificial Sequence: Synthetic peptide
  XENP019948 vhCDR2
FISYDGNNKYYADSVKG

SEQ ID NO: 1952 - protein, 9 aa, Artificial Sequence
  Description of Artificial Sequence: Synthetic peptide
  XENP019948 vhCDR3
TGWLGPFDY

SEQ ID NO: 1953 - protein, 12 aa, Artificial Sequence
  Description of Artificial Sequence: Synthetic peptide
  XENP019948 vlCDR1
RASQSVGSSYLA

SEQ ID NO: 1954 - protein, 7 aa, Artificial Sequence
  Description of Artificial Sequence: Synthetic peptide
  XENP019948 vlCDR2
GAFSRAT

SEQ ID NO: 1955 - protein, 9 aa, Artificial Sequence
  Description of Artificial Sequence: Synthetic peptide
  XENP019948 vlCDR3
QQYGSSPWT

SEQ ID NO: 1956 - protein, 246 aa, Artificial Sequence
  Description of Artificial Sequence: Synthetic polypeptide
  XENP019949 [CTLA-4]_H0_L0.61_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRRLIYGAFSRDTGIPDRFSGSGSGTDFTLTISRLEPEDFAVYYCQQYGSSPWTFGQGTKVEIK

SEQ ID NO: 1957 - protein, 118 aa, Artificial Sequence; identical to SEQ ID NO: 22
  Description of Artificial Sequence: Synthetic polypeptide
  VH of XENP019949

SEQ ID NO: 1958 - protein, 108 aa, Artificial Sequence
  Description of Artificial Sequence: Synthetic polypeptide
  VL of XENP019949
EIVLTQSPGTLSLSPGERATLSCRASQSVGSSYLAWYQQKPGQAPRRLIYGAFSRDTGIPDRFSGSGSGTDFTLTISRLEPEDFAVYYCQQYGSSPWTFGQGTKVEIK

SEQ ID NO: 1959 - protein, 5 aa, Artificial Sequence
  Description of Artificial Sequence: Synthetic peptide
  XENP019949 vhCDR1
SYTMH

SEQ ID NO: 1960 - protein, 17 aa, Artificial Sequence
  Description of Artificial Sequence: Synthetic peptide
  XENP019949 vhCDR2
FISYDGNNKYYADSVKG

SEQ ID NO: 1961 - protein, 9 aa, Artificial Sequence
  Description of Artificial Sequence: Synthetic peptide
  XENP019949 vhCDR3
TGWLGPFDY

SEQ ID NO: 1962 - protein, 12 aa, Artificial Sequence
  Description of Artificial Sequence: Synthetic peptide
  XENP019949 vlCDR1
RASQSVGSSYLA

SEQ ID NO: 1963 - protein, 7 aa, Artificial Sequence
  Description of Artificial Sequence: Synthetic peptide
  XENP019949 vlCDR2
GAFSRDT

SEQ ID NO: 1964 - protein, 9 aa, Artificial Sequence
  Description of Artificial Sequence: Synthetic peptide
  XENP019949 vlCDR3
QQYGSSPWT

SEQ ID NO: 1965 - protein, 246 aa, Artificial Sequence
  Description of Artificial Sequence: Synthetic polypeptide
  XENP019950 [CTLA-4]_H0_L0.62_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIAGAFSRATGIPDRFSGSGSGTDFTLTISRLEPEDFAVYYCQQYGSSPWTFGQGTKVEIK

SEQ ID NO: 1966 - protein, 118 aa, Artificial Sequence; identical to SEQ ID NO: 22
  Description of Artificial Sequence: Synthetic polypeptide
  VH of XENP019950

SEQ ID NO: 1967 - protein, 108 aa, Artificial Sequence
  Description of Artificial Sequence: Synthetic polypeptide
  VL of XENP019950
EIVLTQSPGTLSLSPGERATLSCRASQSVGSSYLAWYQQKPGQAPRLLIAGAFSRATGIPDRFSGSGSGTDFTLTISRLEPEDFAVYYCQQYGSSPWTFGQGTKVEIK

SEQ ID NO: 1968 - protein, 5 aa, Artificial Sequence
  Description of Artificial Sequence: Synthetic peptide
  XENP019950 vhCDR1
SYTMH

SEQ ID NO: 1969 - protein, 17 aa, Artificial Sequence
  Description of Artificial Sequence: Synthetic peptide
  XENP019950 vhCDR2
FISYDGNNKYYADSVKG

SEQ ID NO: 1970 - protein, 9 aa, Artificial Sequence
  Description of Artificial Sequence: Synthetic peptide
  XENP019950 vhCDR3
TGWLGPFDY

SEQ ID NO: 1971 - protein, 12 aa, Artificial Sequence
  Description of Artificial Sequence: Synthetic peptide
  XENP019950 vlCDR1
RASQSVGSSYLA

SEQ ID NO: 1972 - protein, 7 aa, Artificial Sequence
  Description of Artificial Sequence: Synthetic peptide
  XENP019950 vlCDR2
GAFSRAT

SEQ ID NO: 1973 - protein, 9 aa, Artificial Sequence
  Description of Artificial Sequence: Synthetic peptide
  XENP019950 vlCDR3
QQYGSSPWT

SEQ ID NO: 1974 - protein, 246 aa, Artificial Sequence
  Description of Artificial Sequence: Synthetic polypeptide
  XENP019951 [CTLA-4]_H0_L0.63_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIFGAFSRATGIPDRFSGSGSGTDFTLTISRLEPEDFAVYYCQQYGSSPWTFGQGTKVEIK

SEQ ID NO: 1975 - protein, 118 aa, Artificial Sequence; identical to SEQ ID NO: 22
  Description of Artificial Sequence: Synthetic polypeptide
  VH of XENP019951

SEQ ID NO: 1976 - protein, 108 aa, Artificial Sequence
  Description of Artificial Sequence: Synthetic polypeptide
  VL of XENP019951
EIVLTQSPGTLSLSPGERATLSCRASQSVGSSYLAWYQQKPGQAPRLLIFGAFSRATGIPDRFSGSGSGTDFTLTISRLEPEDFAVYYCQQYGSSPWTFGQGTKVEIK

SEQ ID NO: 1977 - protein, 5 aa, Artificial Sequence
  Description of Artificial Sequence: Synthetic peptide
  XENP019951 vhCDR1
SYTMH

SEQ ID NO: 1978 - protein, 17 aa, Artificial Sequence
  Description of Artificial Sequence: Synthetic peptide
  XENP019951 vhCDR2
FISYDGNNKYYADSVKG

SEQ ID NO: 1979 - protein, 9 aa, Artificial Sequence
  Description of Artificial Sequence: Synthetic peptide
  XENP019951 vhCDR3
TGWLGPFDY

SEQ ID NO: 1980 - protein, 12 aa, Artificial Sequence
  Description of Artificial Sequence: Synthetic peptide
  XENP019951 vlCDR1
RASQSVGSSYLA

SEQ ID NO: 1981 - protein, 7 aa, Artificial Sequence
  Description of Artificial Sequence: Synthetic peptide
  XENP019951 vlCDR2
GAFSRAT

SEQ ID NO: 1982 - protein, 9 aa, Artificial Sequence
  Description of Artificial Sequence: Synthetic peptide
  XENP019951 vlCDR3
QQYGSSPWT

SEQ ID NO: 1983 - protein, 246 aa, Artificial Sequence
  Description of Artificial Sequence: Synthetic polypeptide
  XENP019952 [CTLA-4]_H0_L0.64_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIHGAFSRATGIPDRFSGSGSGTDFTLTISRLEPEDFAVYYCQQYGSSPWTFGQGTKVEIK

SEQ ID NO: 1984 - protein, 118 aa, Artificial Sequence; identical to SEQ ID NO: 22
  Description of Artificial Sequence: Synthetic polypeptide
  VH of XENP019952

SEQ ID NO: 1985 - protein, 108 aa, Artificial Sequence
  Description of Artificial Sequence: Synthetic polypeptide
  VL of XENP019952
EIVLTQSPGTLSLSPGERATLSCRASQSVGSSYLAWYQQKPGQAPRLLIHGAFSRATGIPDRFSGSGSGTDFTLTISRLEPEDFAVYYCQQYGSSPWTFGQGTKVEIK

SEQ ID NO: 1986 - protein, 5 aa, Artificial Sequence
  Description of Artificial Sequence: Synthetic peptide
  XENP019952 vhCDR1
SYTMH

SEQ ID NO: 1987 - protein, 17 aa, Artificial Sequence
  Description of Artificial Sequence: Synthetic peptide
  XENP019952 vhCDR2
FISYDGNNKYYADSVKG

SEQ ID NO: 1988 - protein, 9 aa, Artificial Sequence
  Description of Artificial Sequence: Synthetic peptide
  XENP019952 vhCDR3
TGWLGPFDY

SEQ ID NO: 1989 - protein, 12 aa, Artificial Sequence
  Description of Artificial Sequence: Synthetic peptide
  XENP019952 vlCDR1
RASQSVGSSYLA

SEQ ID NO: 1990 - protein, 7 aa, Artificial Sequence
  Description of Artificial Sequence: Synthetic peptide
  XENP019952 vlCDR2
GAFSRAT

SEQ ID NO: 1991 - protein, 9 aa, Artificial Sequence
  Description of Artificial Sequence: Synthetic peptide
  XENP019952 vlCDR3
QQYGSSPWT

SEQ ID NO: 1992 - protein, 246 aa, Artificial Sequence
  Description of Artificial Sequence: Synthetic polypeptide
  XENP019953 [CTLA-4]_H0_L0.65_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLILGAFSRATGIPDRFSGSGSGTDFTLTISRLEPEDFAVYYCQQYGSSPWTFGQGTKVEIK

SEQ ID NO: 1993 - protein, 118 aa, Artificial Sequence; identical to SEQ ID NO: 22
  Description of Artificial Sequence: Synthetic polypeptide
  VH of XENP019953

SEQ ID NO: 1994 - protein, 108 aa, Artificial Sequence
  Description of Artificial Sequence: Synthetic polypeptide
  VL of XENP019953
EIVLTQSPGTLSLSPGERATLSCRASQSVGSSYLAWYQQKPGQAPRLLILGAFSRATGIPDRFSGSGSGTDFTLTISRLEPEDFAVYYCQQYGSSPWTFGQGTKVEIK

SEQ ID NO: 1995 - protein, 5 aa, Artificial Sequence
  Description of Artificial Sequence: Synthetic peptide
  XENP019953 vhCDR1
SYTMH

SEQ ID NO: 1996 - protein, 17 aa, Artificial Sequence
  Description of Artificial Sequence: Synthetic peptide
  XENP019953 vhCDR2
FISYDGNNKYYADSVKG

SEQ ID NO: 1997 - protein, 9 aa, Artificial Sequence
  Description of Artificial Sequence: Synthetic peptide
  XENP019953 vhCDR3
TGWLGPFDY

SEQ ID NO: 1998 - protein, 12 aa, Artificial Sequence
  Description of Artificial Sequence: Synthetic peptide
  XENP019953 vlCDR1
RASQSVGSSYLA

SEQ ID NO: 1999 - protein, 7 aa, Artificial Sequence
  Description of Artificial Sequence: Synthetic peptide
  XENP019953 vlCDR2
GAFSRAT

SEQ ID NO: 2000 - protein, 9 aa, Artificial Sequence
  Description of Artificial Sequence: Synthetic peptide
  XENP019953 vlCDR3
QQYGSSPWT

SEQ ID NO: 2001 - protein, 246 aa, Artificial Sequence
  Description of Artificial Sequence: Synthetic polypeptide
  XENP019954 [CTLA-4]_H0_L0.66_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIVGAFSRATGIPDRFSGSGSGTDFTLTISRLEPEDFAVYYCQQYGSSPWTFGQGTKVEIK

SEQ ID NO: 2002 - protein, 118 aa, Artificial Sequence; identical to SEQ ID NO: 22
  Description of Artificial Sequence: Synthetic polypeptide
  VH of XENP019954

SEQ ID NO: 2003 - protein, 108 aa, Artificial Sequence
  Description of Artificial Sequence: Synthetic polypeptide
  VL of XENP019954
EIVLTQSPGTLSLSPGERATLSCRASQSVGSSYLAWYQQKPGQAPRLLIVGAFSRATGIPDRFSGSGSGTDFTLTISRLEPEDFAVYYCQQYGSSPWTFGQGTKVEIK

SEQ ID NO: 2004 - protein, 5 aa, Artificial Sequence
  Description of Artificial Sequence: Synthetic peptide
  XENP019954 vhCDR1
SYTMH

SEQ ID NO: 2005 - protein, 17 aa, Artificial Sequence
  Description of Artificial Sequence: Synthetic peptide
  XENP019954 vhCDR2
FISYDGNNKYYADSVKG

SEQ ID NO: 2006 - protein, 9 aa, Artificial Sequence
  Description of Artificial Sequence: Synthetic peptide
  XENP019954 vhCDR3
TGWLGPFDY

SEQ ID NO: 2007 - protein, 12 aa, Artificial Sequence
  Description of Artificial Sequence: Synthetic peptide
  XENP019954 vlCDR1
RASQSVGSSYLA

SEQ ID NO: 2008 - protein, 7 aa, Artificial Sequence
  Description of Artificial Sequence: Synthetic peptide
  XENP019954 vlCDR2
GAFSRAT

SEQ ID NO: 2009 - protein, 9 aa, Artificial Sequence
  Description of Artificial Sequence: Synthetic peptide
  XENP019954 vlCDR3
QQYGSSPWT

SEQ ID NO: 2010 - protein, 246 aa, Artificial Sequence
  Description of Artificial Sequence: Synthetic polypeptide
  XENP019955 [CTLA-4]_H0_L0.67_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYDAFSRATGIPDRFSGSGSGTDFTLTISRLEPEDFAVYYCQQYGSSPWTFGQGTKVEIK

SEQ ID NO: 2011 - protein, 118 aa, Artificial Sequence; identical to SEQ ID NO: 22
  Description of Artificial Sequence: Synthetic polypeptide
  VH of XENP019955

SEQ ID NO: 2012 - protein, 108 aa, Artificial Sequence
  Description of Artificial Sequence: Synthetic polypeptide
  VL of XENP019955
EIVLTQSPGTLSLSPGERATLSCRASQSVGSSYLAWYQQKPGQAPRLLIYDAFSRATGIPDRFSGSGSGTDFTLTISRLEPEDFAVYYCQQYGSSPWTFGQGTKVEIK

SEQ ID NO: 2013 - protein, 5 aa, Artificial Sequence
  Description of Artificial Sequence: Synthetic peptide
  XENP019955 vhCDR1
SYTMH

SEQ ID NO: 2014 - protein, 17 aa, Artificial Sequence
  Description of Artificial Sequence: Synthetic peptide
  XENP019955 vhCDR2
FISYDGNNKYYADSVKG

SEQ ID NO: 2015 - protein, 9 aa, Artificial Sequence
  Description of Artificial Sequence: Synthetic peptide
  XENP019955 vhCDR3
TGWLGPFDY

SEQ ID NO: 2016 - protein, 12 aa, Artificial Sequence
  Description of Artificial Sequence: Synthetic peptide
  XENP019955 vlCDR1
RASQSVGSSYLA

SEQ ID NO: 2017 - protein, 7 aa, Artificial Sequence
  Description of Artificial Sequence: Synthetic peptide
  XENP019955 vlCDR2
DAFSRAT

SEQ ID NO: 2018 - protein, 9 aa, Artificial Sequence
  Description of Artificial Sequence: Synthetic peptide
  XENP019955 vlCDR3
QQYGSSPWT

SEQ ID NO: 2019 - protein, 246 aa, Artificial Sequence
  Description of Artificial Sequence: Synthetic polypeptide
  XENP019956 [CTLA-4]_H0_L0.68_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYSAFSRATGIPDRFSGSGSGTDFTLTISRLEPEDFAVYYCQQYGSSPWTFGQGTKVEIK

SEQ ID NO: 2020 - protein, 118 aa, Artificial Sequence; identical to SEQ ID NO: 22
  Description of Artificial Sequence: Synthetic polypeptide
  VH of XENP019956

SEQ ID NO: 2021 - protein, 108 aa, Artificial Sequence
  Description of Artificial Sequence: Synthetic polypeptide
  VL of XENP019956
EIVLTQSPGTLSLSPGERATLSCRASQSVGSSYLAWYQQKPGQAPRLLIYSAFSRATGIPDRFSGSGSGTDFTLTISRLEPEDFAVYYCQQYGSSPWTFGQGTKVEIK

SEQ ID NO: 2022 - protein, 5 aa, Artificial Sequence
  Description of Artificial Sequence: Synthetic peptide
  XENP019956 vhCDR1
SYTMH

SEQ ID NO: 2023 - protein, 17 aa, Artificial Sequence
  Description of Artificial Sequence: Synthetic peptide
  XENP019956 vhCDR2
FISYDGNNKYYADSVKG

SEQ ID NO: 2024 - protein, 9 aa, Artificial Sequence
  Description of Artificial Sequence: Synthetic peptide
  XENP019956 vhCDR3
TGWLGPFDY

SEQ ID NO: 2025 - protein, 12 aa, Artificial Sequence
  Description of Artificial Sequence: Synthetic peptide
  XENP019956 vlCDR1
RASQSVGSSYLA

SEQ ID NO: 2026 - protein, 7 aa, Artificial Sequence
  Description of Artificial Sequence: Synthetic peptide
  XENP019956 vlCDR2
SAFSRAT

SEQ ID NO: 2027 - protein, 9 aa, Artificial Sequence
  Description of Artificial Sequence: Synthetic peptide
  XENP019956 vlCDR3
QQYGSSPWT

SEQ ID NO: 2028 - protein, 246 aa, Artificial Sequence
  Description of Artificial Sequence: Synthetic polypeptide
  XENP019957 [CTLA-4]_H0_L0.69_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGVFSRATGIPDRFSGSGSGTDFTLTISRLEPEDFAVYYCQQYGSSPWTFGQGTKVEIK

SEQ ID NO: 2029 - protein, 118 aa, Artificial Sequence; identical to SEQ ID NO: 22
  Description of Artificial Sequence: Synthetic polypeptide
  VH of XENP019957

SEQ ID NO: 2030 - protein, 108 aa, Artificial Sequence
  Description of Artificial Sequence: Synthetic polypeptide
  VL of XENP019957
EIVLTQSPGTLSLSPGERATLSCRASQSVGSSYLAWYQQKPGQAPRLLIYGVFSRATGIPDRFSGSGSGTDFTLTISRLEPEDFAVYYCQQYGSSPWTFGQGTKVEIK

SEQ ID NO: 2031 - protein, 5 aa, Artificial Sequence
  Description of Artificial Sequence: Synthetic peptide
  XENP019957 vhCDR1
SYTMH

SEQ ID NO: 2032 - protein, 17 aa, Artificial Sequence
  Description of Artificial Sequence: Synthetic peptide
  XENP019957 vhCDR2
FISYDGNNKYYADSVKG

SEQ ID NO: 2033 - protein, 9 aa, Artificial Sequence
  Description of Artificial Sequence: Synthetic peptide
  XENP019957 vhCDR3
TGWLGPFDY

SEQ ID NO: 2034 - protein, 12 aa, Artificial Sequence
  Description of Artificial Sequence: Synthetic peptide
  XENP019957 vlCDR1
RASQSVGSSYLA

SEQ ID NO: 2035 - protein, 7 aa, Artificial Sequence
  Description of Artificial Sequence: Synthetic peptide
  XENP019957 vlCDR2
GVFSRAT

SEQ ID NO: 2036 - protein, 9 aa, Artificial Sequence
  Description of Artificial Sequence: Synthetic peptide
  XENP019957 vlCDR3
QQYGSSPWT

SEQ ID NO: 2037 - protein, 246 aa, Artificial Sequence
  Description of Artificial Sequence: Synthetic polypeptide
  XENP019958 [CTLA-4]_H0_L0.70_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAHSRATGIPDRFSGSGSGTDFTLTISRLEPEDFAVYYCQQYGSSPWTFGQGTKVEIK

SEQ ID NO: 2038 - protein, 118 aa, Artificial Sequence; identical to SEQ ID NO: 22
  Description of Artificial Sequence: Synthetic polypeptide
  VH of XENP019958

SEQ ID NO: 2039 - protein, 108 aa, Artificial Sequence
  Description of Artificial Sequence: Synthetic polypeptide
  VL of XENP019958
EIVLTQSPGTLSLSPGERATLSCRASQSVGSSYLAWYQQKPGQAPRLLIYGAHSRATGIPDRFSGSGSGTDFTLTISRLEPEDFAVYYCQQYGSSPWTFGQGTKVEIK

SEQ ID NO: 2040 - protein, 5 aa, Artificial Sequence
  Description of Artificial Sequence: Synthetic peptide
  XENP019958 vhCDR1
SYTMH

SEQ ID NO: 2041 - protein, 17 aa, Artificial Sequence
  Description of Artificial Sequence: Synthetic peptide
  XENP019958 vhCDR2
FISYDGNNKYYADSVKG

SEQ ID NO: 2042 - protein, 9 aa, Artificial Sequence
  Description of Artificial Sequence: Synthetic peptide
  XENP019958 vhCDR3
TGWLGPFDY

SEQ ID NO: 2043 - protein, 12 aa, Artificial Sequence
  Description of Artificial Sequence: Synthetic peptide
  XENP019958 vlCDR1
RASQSVGSSYLA

SEQ ID NO: 2044 - protein, 7 aa, Artificial Sequence
  Description of Artificial Sequence: Synthetic peptide
  XENP019958 vlCDR2
GAHSRAT

SEQ ID NO: 2045 - protein, 9 aa, Artificial Sequence
  Description of Artificial Sequence: Synthetic peptide
  XENP019958 vlCDR3
QQYGSSPWT

SEQ ID NO: 2046 - protein, 246 aa, Artificial Sequence
  Description of Artificial Sequence: Synthetic polypeptide
  XENP019959 [CTLA-4]_H0_L0.71_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAISRATGIPDRFSGSGSGTDFTLTISRLEPEDFAVYYCQQYGSSPWTFGQGTKVEIK

SEQ ID NO: 2047 - protein, 118 aa, Artificial Sequence; identical to SEQ ID NO: 22
  Description of Artificial Sequence: Synthetic polypeptide
  VH of XENP019959

SEQ ID NO: 2048 - protein, 108 aa, Artificial Sequence
  Description of Artificial Sequence: Synthetic polypeptide
  VL of XENP019959
EIVLTQSPGTLSLSPGERATLSCRASQSVGSSYLAWYQQKPGQAPRLLIYGAISRATGIPDRFSGSGSGTDFTLTISRLEPEDFAVYYCQQYGSSPWTFGQGTKVEIK

SEQ ID NO: 2049 - protein, 5 aa, Artificial Sequence
  Description of Artificial Sequence: Synthetic peptide
  XENP019959 vhCDR1
SYTMH

SEQ ID NO: 2050 - protein, 17 aa, Artificial Sequence
  Description of Artificial Sequence: Synthetic peptide
  XENP019959 vhCDR2
FISYDGNNKYYADSVKG

SEQ ID NO: 2051 - protein, 9 aa, Artificial Sequence
  Description of Artificial Sequence: Synthetic peptide
  XENP019959 vhCDR3
TGWLGPFDY

SEQ ID NO: 2052 - protein, 12 aa, Artificial Sequence
  Description of Artificial Sequence: Synthetic peptide
  XENP019959 vlCDR1
RASQSVGSSYLA

SEQ ID NO: 2053 - protein, 7 aa, Artificial Sequence
  Description of Artificial Sequence: Synthetic peptide
  XENP019959 vlCDR2
GAISRAT

SEQ ID NO: 2054 - protein, 9 aa, Artificial Sequence
  Description of Artificial Sequence: Synthetic peptide
  XENP019959 vlCDR3
QQYGSSPWT

SEQ ID NO: 2055 - protein, 246 aa, Artificial Sequence
  Description of Artificial Sequence: Synthetic polypeptide
  XENP019960 [CTLA-4]_H0_L0.72_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGALSRATGIPDRFSGSGSGTDFTLTISRLEPEDFAVYYCQQYGSSPWTFGQGTKVEIK

SEQ ID NO: 2056 - protein, 118 aa, Artificial Sequence; identical to SEQ ID NO: 22
  Description of Artificial Sequence: Synthetic polypeptide
  VH of XENP019960

SEQ ID NO: 2057 - protein, 108 aa, Artificial Sequence
  Description of Artificial Sequence: Synthetic polypeptide
  VL of XENP019960
EIVLTQSPGTLSLSPGERATLSCRASQSVGSSYLAWYQQKPGQAPRLLIYGALSRATGIPDRFSGSGSGTDFTLTISRLEPEDFAVYYCQQYGSSPWTFGQGTKVEIK

SEQ ID NO: 2058 - protein, 5 aa, Artificial Sequence
  Description of Artificial Sequence: Synthetic peptide
  XENP019960 vhCDR1
SYTMH

SEQ ID NO: 2059 - protein, 17 aa, Artificial Sequence
  Description of Artificial Sequence: Synthetic peptide
  XENP019960 vhCDR2
FISYDGNNKYYADSVKG

SEQ ID NO: 2060 - protein, 9 aa, Artificial Sequence
  Description of Artificial Sequence: Synthetic peptide
  XENP019960 vhCDR3
TGWLGPFDY

SEQ ID NO: 2061 - protein, 12 aa, Artificial Sequence
  Description of Artificial Sequence: Synthetic peptide
  XENP019960 vlCDR1
RASQSVGSSYLA

SEQ ID NO: 2062 - protein, 7 aa, Artificial Sequence
  Description of Artificial Sequence: Synthetic peptide
  XENP019960 vlCDR2
GALSRAT

SEQ ID NO: 2063 - protein, 9 aa, Artificial Sequence
  Description of Artificial Sequence: Synthetic peptide
  XENP019960 vlCDR3
QQYGSSPWT

SEQ ID NO: 2064 - protein, 246 aa, Artificial Sequence
  Description of Artificial Sequence: Synthetic polypeptide
  XENP019961 [CTLA-4]_H0_L0.73_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIK

SEQ ID NO: 2065 - protein, 118 aa, Artificial Sequence; identical to SEQ ID NO: 22
  Description of Artificial Sequence: Synthetic polypeptide
  VH of XENP019961

SEQ ID NO: 2066 - protein, 108 aa, Artificial Sequence
  Description of Artificial Sequence: Synthetic polypeptide
  VL of XENP019961
EIVLTQSPGTLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIK

SEQ ID NO: 2067 - protein, 5 aa, Artificial Sequence
  Description of Artificial Sequence: Synthetic peptide
  XENP019961 vhCDR1
SYTMH

SEQ ID NO: 2068 - protein, 17 aa, Artificial Sequence
  Description of Artificial Sequence: Synthetic peptide
  XENP019961 vhCDR2
FISYDGNNKYYADSVKG

SEQ ID NO: 2069 - protein, 9 aa, Artificial Sequence
  Description of Artificial Sequence: Synthetic peptide
  XENP019961 vhCDR3
TGWLGPFDY

SEQ ID NO: 2070 - protein, 12 aa, Artificial Sequence
  Description of Artificial Sequence: Synthetic peptide
  XENP019961 vlCDR1
RASQSVGSSYLA

SEQ ID NO: 2071 - protein, 7 aa, Artificial Sequence
  Description of Artificial Sequence: Synthetic peptide
  XENP019961 vlCDR2
GASSRAT

SEQ ID NO: 2072 - protein, 9 aa, Artificial Sequence
  Description of Artificial Sequence: Synthetic peptide
  XENP019961 vlCDR3
QQYGSSPWT

SEQ ID NO: 2073 - protein, 246 aa, Artificial Sequence
  Description of Artificial Sequence: Synthetic polypeptide
  XENP019962 [CTLA-4]_H0_L0.74_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAYSRATGIPDRFSGSGSGTDFTLTISRLEPEDFAVYYCQQYGSSPWTFGQGTKVEIK

SEQ ID NO: 2074 - protein, 118 aa, Artificial Sequence; identical to SEQ ID NO: 22
  Description of Artificial Sequence: Synthetic polypeptide
  VH of XENP019962

SEQ ID NO: 2075 - protein, 108 aa, Artificial Sequence
  Description of Artificial Sequence: Synthetic polypeptide
  VL of XENP019962
EIVLTQSPGTLSLSPGERATLSCRASQSVGSSYLAWYQQKPGQAPRLLIYGAYSRATGIPDRFSGSGSGTDFTLTISRLEPEDFAVYYCQQYGSSPWTFGQGTKVEIK

SEQ ID NO: 2076 - protein, 5 aa, Artificial Sequence
  Description of Artificial Sequence: Synthetic peptide
  XENP019962 vhCDR1
SYTMH

SEQ ID NO: 2077 - protein, 17 aa, Artificial Sequence
  Description of Artificial Sequence: Synthetic peptide
  XENP019962 vhCDR2
FISYDGNNKYYADSVKG

SEQ ID NO: 2078 - protein, 9 aa, Artificial Sequence
  Description of Artificial Sequence: Synthetic peptide
  XENP019962 vhCDR3
TGWLGPFDY

SEQ ID NO: 2079 - protein, 12 aa, Artificial Sequence
  Description of Artificial Sequence: Synthetic peptide
  XENP019962 vlCDR1
RASQSVGSSYLA

SEQ ID NO: 2080 - protein, 7 aa, Artificial Sequence
  Description of Artificial Sequence: Synthetic peptide
  XENP019962 vlCDR2
GAYSRAT

SEQ ID NO: 2081 - protein, 9 aa, Artificial Sequence
  Description of Artificial Sequence: Synthetic peptide
  XENP019962 vlCDR3
QQYGSSPWT

SEQ ID NO: 2082 - protein, 246 aa, Artificial Sequence
  Description of Artificial Sequence: Synthetic polypeptide
  XENP019963 [CTLA-4]_H0_L0.75_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFARATGIPDRFSGSGSGTDFTLTISRLEPEDFAVYYCQQYGSSPWTFGQGTKVEIK

SEQ ID NO: 2083 - protein, 118 aa, Artificial Sequence; identical to SEQ ID NO: 22
  Description of Artificial Sequence: Synthetic polypeptide
  VH of XENP019963

SEQ ID NO: 2084 - protein, 108 aa, Artificial Sequence
  Description of Artificial Sequence: Synthetic polypeptide
  VL of XENP019963
EIVLTQSPGTLSLSPGERATLSCRASQSVGSSYLAWYQQKPGQAPRLLIYGAFARATGIPDRFSGSGSGTDFTLTISRLEPEDFAVYYCQQYGSSPWTFGQGTKVEIK

SEQ ID NO: 2085 - protein, 5 aa, Artificial Sequence
  Description of Artificial Sequence: Synthetic peptide
  XENP019963 vhCDR1
SYTMH

SEQ ID NO: 2086 - protein, 17 aa, Artificial Sequence
  Description of Artificial Sequence: Synthetic peptide
  XENP019963 vhCDR2
FISYDGNNKYYADSVKG

SEQ ID NO: 2087 - protein, 9 aa, Artificial Sequence
  Description of Artificial Sequence: Synthetic peptide
  XENP019963 vhCDR3
TGWLGPFDY

SEQ ID NO: 2088 - protein, 12 aa, Artificial Sequence
  Description of Artificial Sequence: Synthetic peptide
  XENP019963 vlCDR1
RASQSVGSSYLA

SEQ ID NO: 2089 - protein, 7 aa, Artificial Sequence
  Description of Artificial Sequence: Synthetic peptide
  XENP019963 vlCDR2
GAFARAT

SEQ ID NO: 2090 - protein, 9 aa, Artificial Sequence
  Description of Artificial Sequence: Synthetic peptide
  XENP019963 vlCDR3
QQYGSSPWT

SEQ ID NO: 2091 - protein, 246 aa, Artificial Sequence
  Description of Artificial Sequence: Synthetic polypeptide
  XENP019964 [CTLA-4]_H0_L0.76_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFGRATGIPDRFSGSGSGTDFTLTISRLEPEDFAVYYCQQYGSSPWTFGQGTKVEIK

SEQ ID NO: 2092 - protein, 118 aa, Artificial Sequence; identical to SEQ ID NO: 22
  Description of Artificial Sequence: Synthetic polypeptide
  VH of XENP019964

SEQ ID NO: 2093 - protein, 108 aa, Artificial Sequence
  Description of Artificial Sequence: Synthetic polypeptide
  VL of XENP019964
EIVLTQSPGTLSLSPGERATLSCRASQSVGSSYLAWYQQKPGQAPRLLIYGAFGRATGIPDRFSGSGSGTDFTLTISRLEPEDFAVYYCQQYGSSPWTFGQGTKVEIK

SEQ ID NO: 2094 - protein, 5 aa, Artificial Sequence
  Description of Artificial Sequence: Synthetic peptide
  XENP019964 vhCDR1
SYTMH

SEQ ID NO: 2095 - protein, 17 aa, Artificial Sequence
  Description of Artificial Sequence: Synthetic peptide
  XENP019964 vhCDR2
FISYDGNNKYYADSVKG

SEQ ID NO: 2096 - protein, 9 aa, Artificial Sequence
  Description of Artificial Sequence: Synthetic peptide
  XENP019964 vhCDR3
TGWLGPFDY

SEQ ID NO: 2097 - protein, 12 aa, Artificial Sequence
  Description of Artificial Sequence: Synthetic peptide
  XENP019964 vlCDR1
RASQSVGSSYLA

SEQ ID NO: 2098 - protein, 7 aa, Artificial Sequence
  Description of Artificial Sequence: Synthetic peptide
  XENP019964 vlCDR2
GAFGRAT

SEQ ID NO: 2099 - protein, 9 aa, Artificial Sequence
  Description of Artificial Sequence: Synthetic peptide
  XENP019964 vlCDR3
QQYGSSPWT

SEQ ID NO: 2100 - protein, 246 aa, Artificial Sequence
  Description of Artificial Sequence: Synthetic polypeptide
  XENP019965 [CTLA-4]_H0_L0.77_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFNRATGIPDRFSGSGSGTDFTLTISRLEPEDFAVYYCQQYGSSPWTFGQGTKVEIK

SEQ ID NO: 2101 - protein, 118 aa, Artificial Sequence; identical to SEQ ID NO: 22
  Description of Artificial Sequence: Synthetic polypeptide
  VH of XENP019965

SEQ ID NO: 2102 - protein, 108 aa, Artificial Sequence
  Description of Artificial Sequence: Synthetic polypeptide
  VL of XENP019965
EIVLTQSPGTLSLSPGERATLSCRASQSVGSSYLAWYQQKPGQAPRLLIYGAFNRATGIPDRFSGSGSGTDFTLTISRLEPEDFAVYYCQQYGSSPWTFGQGTKVEIK

SEQ ID NO: 2103 - protein, 5 aa, Artificial Sequence
  Description of Artificial Sequence: Synthetic peptide
  XENP019965 vhCDR1
SYTMH

SEQ ID NO: 2104 - protein, 17 aa, Artificial Sequence
  Description of Artificial Sequence: Synthetic peptide
  XENP019965 vhCDR2
FISYDGNNKYYADSVKG

SEQ ID NO: 2105 - protein, 9 aa, Artificial Sequence
  Description of Artificial Sequence: Synthetic peptide
  XENP019965 vhCDR3
TGWLGPFDY

SEQ ID NO: 2106 - protein, 12 aa, Artificial Sequence
  Description of Artificial Sequence: Synthetic peptide
  XENP019965 vlCDR1
RASQSVGSSYLA

SEQ ID NO: 2107 - protein, 7 aa, Artificial Sequence
  Description of Artificial Sequence: Synthetic peptide
  XENP019965 vlCDR2
GAFNRAT

SEQ ID NO: 2108 - protein, 9 aa, Artificial Sequence
  Description of Artificial Sequence: Synthetic peptide
  XENP019965 vlCDR3
QQYGSSPWT

SEQ ID NO: 2109 - protein, 246 aa, Artificial Sequence
  Description of Artificial Sequence: Synthetic polypeptide
  XENP019966 [CTLA-4]_H0_L0.78_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFQRATGIPDRFSGSGSGTDFTLTISRLEPEDFAVYYCQQYGSSPWTFGQGTKVEIK

SEQ ID NO: 2110 - protein, 118 aa, Artificial Sequence; identical to SEQ ID NO: 22
  Description of Artificial Sequence: Synthetic polypeptide
  VH of XENP019966

SEQ ID NO: 2111 - protein, 108 aa, Artificial Sequence
  Description of Artificial Sequence: Synthetic polypeptide
  VL of XENP019966
EIVLTQSPGTLSLSPGERATLSCRASQSVGSSYLAWYQQKPGQAPRLLIYGAFQRATGIPDRFSGSGSGTDFTLTISRLEPEDFAVYYCQQYGSSPWTFGQGTKVEIK

SEQ ID NO: 2112 - protein, 5 aa, Artificial Sequence
  Description of Artificial Sequence: Synthetic peptide
  XENP019966 vhCDR1
SYTMH

SEQ ID NO: 2113 - protein, 17 aa, Artificial Sequence
  Description of Artificial Sequence: Synthetic peptide
  XENP019966 vhCDR2
FISYDGNNKYYADSVKG

SEQ ID NO: 2114 - protein, 9 aa, Artificial Sequence
  Description of Artificial Sequence: Synthetic peptide
  XENP019966 vhCDR3
TGWLGPFDY

SEQ ID NO: 2115 - protein, 12 aa, Artificial Sequence
  Description of Artificial Sequence: Synthetic peptide
  XENP019966 vlCDR1
RASQSVGSSYLA

SEQ ID NO: 2116 - protein, 7 aa, Artificial Sequence
  Description of Artificial Sequence: Synthetic peptide
  XENP019966 vlCDR2
GAFQRAT

SEQ ID NO: 2117 - protein, 9 aa, Artificial Sequence
  Description of Artificial Sequence: Synthetic peptide
  XENP019966 vlCDR3
QQYGSSPWT

SEQ ID NO: 2118 - protein, 246 aa, Artificial Sequence
  Description of Artificial Sequence: Synthetic polypeptide
  XENP019967 [CTLA-4]_H0_L0.79_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFTRATGIPDRFSGSGSGTDFTLTISRLEPEDFAVYYCQQYGSSPWTFGQGTKVEIK

SEQ ID NO: 2119 - protein, 118 aa, Artificial Sequence; identical to SEQ ID NO: 22
  Description of Artificial Sequence: Synthetic polypeptide
  VH of XENP019967

SEQ ID NO: 2120 - protein, 108 aa, Artificial Sequence
  Description of Artificial Sequence: Synthetic polypeptide
  VL of XENP019967
EIVLTQSPGTLSLSPGERATLSCRASQSVGSSYLAWYQQKPGQAPRLLIYGAFTRATGIPDRFSGSGSGTDFTLTISRLEPEDFAVYYCQQYGSSPWTFGQGTKVEIK

SEQ ID NO: 2121 - protein, 5 aa, Artificial Sequence
  Description of Artificial Sequence: Synthetic peptide
  XENP019967 vhCDR1
SYTMH

SEQ ID NO: 2122 - protein, 17 aa, Artificial Sequence
  Description of Artificial Sequence: Synthetic peptide
  XENP019967 vhCDR2
FISYDGNNKYYADSVKG

SEQ ID NO: 2123 - protein, 9 aa, Artificial Sequence
  Description of Artificial Sequence: Synthetic peptide
  XENP019967 vhCDR3
TGWLGPFDY

SEQ ID NO: 2124 - protein, 12 aa, Artificial Sequence
  Description of Artificial Sequence: Synthetic peptide
  XENP019967 vlCDR1
RASQSVGSSYLA

SEQ ID NO: 2125 - protein, 7 aa, Artificial Sequence
  Description of Artificial Sequence: Synthetic peptide
  XENP019967 vlCDR2
GAFTRAT

SEQ ID NO: 2126 - protein, 9 aa, Artificial Sequence
  Description of Artificial Sequence: Synthetic peptide
  XENP019967 vlCDR3
QQYGSSPWT

SEQ ID NO: 2127 - protein, 246 aa, Artificial Sequence
  Description of Artificial Sequence: Synthetic polypeptide
  XENP019968 [CTLA-4]_H0_L0.80_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRDTGIPDRFSGSGSGTDFTLTISRLEPEDFAVYYCQQYGSSPWTFGQGTKVEIK

SEQ ID NO: 2128 - protein, 118 aa, Artificial Sequence; identical to SEQ ID NO: 22
  Description of Artificial Sequence: Synthetic polypeptide
  VH of XENP019968

SEQ ID NO: 2129 - protein, 108 aa, Artificial Sequence
  Description of Artificial Sequence: Synthetic polypeptide
  VL of XENP019968
EIVLTQSPGTLSLSPGERATLSCRASQSVGSSYLAWYQQKPGQAPRLLIYGAFSRDTGIPDRFSGSGSGTDFTLTISRLEPEDFAVYYCQQYGSSPWTFGQGTKVEIK

SEQ ID NO: 2130 - protein, 5 aa, Artificial Sequence
  Description of Artificial Sequence: Synthetic peptide
  XENP019968 vhCDR1
SYTMH

SEQ ID NO: 2131 - protein, 17 aa, Artificial Sequence
  Description of Artificial Sequence: Synthetic peptide
  XENP019968 vhCDR2
FISYDGNNKYYADSVKG

SEQ ID NO: 2132 - protein, 9 aa, Artificial Sequence
  Description of Artificial Sequence: Synthetic peptide
  XENP019968 vhCDR3
TGWLGPFDY

SEQ ID NO: 2133 - protein, 12 aa, Artificial Sequence
  Description of Artificial Sequence: Synthetic peptide
  XENP019968 vlCDR1
RASQSVGSSYLA

SEQ ID NO: 2134 - protein, 7 aa, Artificial Sequence
  Description of Artificial Sequence: Synthetic peptide
  XENP019968 vlCDR2
GAFSRDT

SEQ ID NO: 2135 - protein, 9 aa, Artificial Sequence
  Description of Artificial Sequence: Synthetic peptide
  XENP019968 vlCDR3
QQYGSSPWT

SEQ ID NO: 2136 - protein, 246 aa, Artificial Sequence
  Description of Artificial Sequence: Synthetic polypeptide
  XENP019969 [CTLA-4]_H0_L0.81_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRASGIPDRFSGSGSGTDFTLTISRLEPEDFAVYYCQQYGSSPWTFGQGTKVEIK

SEQ ID NO: 2137 - protein, 118 aa, Artificial Sequence; identical to SEQ ID NO: 22
  Description of Artificial Sequence: Synthetic polypeptide
  VH of XENP019969

SEQ ID NO: 2138 - protein, 108 aa, Artificial Sequence
  Description of Artificial Sequence: Synthetic polypeptide
  VL of XENP019969
EIVLTQSPGTLSLSPGERATLSCRASQSVGSSYLAWYQQKPGQAPRLLIYGAFSRASGIPDRFSGSGSGTDFTLTISRLEPEDFAVYYCQQYGSSPWTFGQGTKVEIK

SEQ ID NO: 2139 - protein, 5 aa, Artificial Sequence
  Description of Artificial Sequence: Synthetic peptide
  XENP019969 vhCDR1
SYTMH

SEQ ID NO: 2140 - protein, 17 aa, Artificial Sequence
  Description of Artificial Sequence: Synthetic peptide
  XENP019969 vhCDR2
FISYDGNNKYYADSVKG

SEQ ID NO: 2141 - protein, 9 aa, Artificial Sequence
  Description of Artificial Sequence: Synthetic peptide
  XENP019969 vhCDR3
TGWLGPFDY

SEQ ID NO: 2142 - protein, 12 aa, Artificial Sequence
  Description of Artificial Sequence: Synthetic peptide
  XENP019969 vlCDR1
RASQSVGSSYLA

SEQ ID NO: 2143 - protein, 7 aa, Artificial Sequence
  Description of Artificial Sequence: Synthetic peptide
  XENP019969 vlCDR2
GAFSRAS

SEQ ID NO: 2144 - protein, 9 aa, Artificial Sequence
  Description of Artificial Sequence: Synthetic peptide
  XENP019969 vlCDR3
QQYGSSPWT

SEQ ID NO: 2145 - protein, 246 aa, Artificial Sequence
  Description of Artificial Sequence: Synthetic polypeptide
  XENP019970 [CTLA-4]_H0_L0.82_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGVPDRFSGSGSGTDFTLTISRLEPEDFAVYYCQQYGSSPWTFGQGTKVEIK

SEQ ID NO: 2146 - protein, 118 aa, Artificial Sequence; identical to SEQ ID NO: 22
  Description of Artificial Sequence: Synthetic polypeptide
  VH of XENP019970

SEQ ID NO: 2147 - protein, 108 aa, Artificial Sequence
  Description of Artificial Sequence: Synthetic polypeptide
  VL of XENP019970
EIVLTQSPGTLSLSPGERATLSCRASQSVGSSYLAWYQQKPGQAPRLLIYGAFSRATGVPDRFSGSGSGTDFTLTISRLEPEDFAVYYCQQYGSSPWTFGQGTKVEIK

SEQ ID NO: 2148 - protein, 5 aa, Artificial Sequence
  Description of Artificial Sequence: Synthetic peptide
  XENP019970 vhCDR1
SYTMH

SEQ ID NO: 2149 - protein, 17 aa, Artificial Sequence
  Description of Artificial Sequence: Synthetic peptide
  XENP019970 vhCDR2
FISYDGNNKYYADSVKG

SEQ ID NO: 2150 - protein, 9 aa, Artificial Sequence
  Description of Artificial Sequence: Synthetic peptide
  XENP019970 vhCDR3
TGWLGPFDY

SEQ ID NO: 2151 - protein, 12 aa, Artificial Sequence
  Description of Artificial Sequence: Synthetic peptide
  XENP019970 vlCDR1
RASQSVGSSYLA

SEQ ID NO: 2152 - protein, 7 aa, Artificial Sequence
  Description of Artificial Sequence: Synthetic peptide
  XENP019970 vlCDR2
GAFSRAT

SEQ ID NO: 2153 - protein, 9 aa, Artificial Sequence
  Description of Artificial Sequence: Synthetic peptide
  XENP019970 vlCDR3
QQYGSSPWT

SEQ ID NO: 2154 - protein, 246 aa, Artificial Sequence
  Description of Artificial Sequence: Synthetic polypeptide
  XENP019971 [CTLA-4]_H0_L0.83_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPARFSGSGSGTDFTLTISRLEPEDFAVYYCQQYGSSPWTFGQGTKVEIK

SEQ ID NO: 2155 - protein, 118 aa, Artificial Sequence; identical to SEQ ID NO: 22
  Description of Artificial Sequence: Synthetic polypeptide
  VH of XENP019971

SEQ ID NO: 2156 - protein, 108 aa, Artificial Sequence
  Description of Artificial Sequence: Synthetic polypeptide
  VL of XENP019971
EIVLTQSPGTLSLSPGERATLSCRASQSVGSSYLAWYQQKPGQAPRLLIYGAFSRATGIPARFSGSGSGTDFTLTISRLEPEDFAVYYCQQYGSSPWTFGQGTKVEIK

SEQ ID NO: 2157 - protein, 5 aa, Artificial Sequence
  Description of Artificial Sequence: Synthetic peptide
  XENP019971 vhCDR1
SYTMH

SEQ ID NO: 2158 - protein, 17 aa, Artificial Sequence
  Description of Artificial Sequence: Synthetic peptide
  XENP019971 vhCDR2
FISYDGNNKYYADSVKG

SEQ ID NO: 2159 - protein, 9 aa, Artificial Sequence
  Description of Artificial Sequence: Synthetic peptide
  XENP019971 vhCDR3
TGWLGPFDY

SEQ ID NO: 2160 - protein, 12 aa, Artificial Sequence
  Description of Artificial Sequence: Synthetic peptide
  XENP019971 vlCDR1
RASQSVGSSYLA

SEQ ID NO: 2161 - protein, 7 aa, Artificial Sequence
  Description of Artificial Sequence: Synthetic peptide
  XENP019971 vlCDR2
GAFSRAT

SEQ ID NO: 2162 - protein, 9 aa, Artificial Sequence
  Description of Artificial Sequence: Synthetic peptide
  XENP019971 vlCDR3
QQYGSSPWT

SEQ ID NO: 2163 - protein, 246 aa, Artificial Sequence
  Description of Artificial Sequence: Synthetic polypeptide
  XENP019972 [CTLA-4]_H0_L0.84_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSRTDFTLTISRLEPEDFAVYYCQQYGSSPWTFGQGTKVEIK

SEQ ID NO: 2164 - protein, 118 aa, Artificial Sequence; identical to SEQ ID NO: 22
  Description of Artificial Sequence: Synthetic polypeptide
  VH of XENP019972

SEQ ID NO: 2165 - protein, 108 aa, Artificial Sequence
  Description of Artificial Sequence: Synthetic polypeptide
  VL of XENP019972
EIVLTQSPGTLSLSPGERATLSCRASQSVGSSYLAWYQQKPGQAPRLLIYGAFSRATGIPDRFSGSGSRTDFTLTISRLEPEDFAVYYCQQYGSSPWTFGQGTKVEIK

SEQ ID NO: 2166 - protein, 5 aa, Artificial Sequence
  Description of Artificial Sequence: Synthetic peptide
  XENP019972 vhCDR1
SYTMH

SEQ ID NO: 2167 - protein, 17 aa, Artificial Sequence
  Description of Artificial Sequence: Synthetic peptide
  XENP019972 vhCDR2
FISYDGNNKYYADSVKG

SEQ ID NO: 2168 - protein, 9 aa, Artificial Sequence
  Description of Artificial Sequence: Synthetic peptide
  XENP019972 vhCDR3
TGWLGPFDY

SEQ ID NO: 2169 - protein, 12 aa, Artificial Sequence
  Description of Artificial Sequence: Synthetic peptide
  XENP019972 vlCDR1
RASQSVGSSYLA

SEQ ID NO: 2170 - protein, 7 aa, Artificial Sequence
  Description of Artificial Sequence: Synthetic peptide
  XENP019972 vlCDR2
GAFSRAT

SEQ ID NO: 2171 - protein, 9 aa, Artificial Sequence
  Description of Artificial Sequence: Synthetic peptide
  XENP019972 vlCDR3
QQYGSSPWT

SEQ ID NO: 2172 - protein, 246 aa, Artificial Sequence
  Description of Artificial Sequence: Synthetic polypeptide
  XENP019973 [CTLA-4]_H0_L0.85_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTEFTLTISRLEPEDFAVYYCQQYGSSPWTFGQGTKVEIK

SEQ ID NO: 2173 - protein, 118 aa, Artificial Sequence; identical to SEQ ID NO: 22
  Description of Artificial Sequence: Synthetic polypeptide
  VH of XENP019973

SEQ ID NO: 2174 - protein, 108 aa, Artificial Sequence
  Description of Artificial Sequence: Synthetic polypeptide
  VL of XENP019973
EIVLTQSPGTLSLSPGERATLSCRASQSVGSSYLAWYQQKPGQAPRLLIYGAFSRATGIPDRFSGSGSGTEFTLTISRLEPEDFAVYYCQQYGSSPWTFGQGTKVEIK

SEQ ID NO: 2175 - protein, 5 aa, Artificial Sequence
  Description of Artificial Sequence: Synthetic peptide
  XENP019973 vhCDR1
SYTMH

SEQ ID NO: 2176 - protein, 17 aa, Artificial Sequence
  Description of Artificial Sequence: Synthetic peptide
  XENP019973 vhCDR2
FISYDGNNKYYADSVKG

SEQ ID NO: 2177 - protein, 9 aa, Artificial Sequence
  Description of Artificial Sequence: Synthetic peptide
  XENP019973 vhCDR3
TGWLGPFDY

SEQ ID NO: 2178 - protein, 12 aa, Artificial Sequence
  Description of Artificial Sequence: Synthetic peptide
  XENP019973 vlCDR1
RASQSVGSSYLA

SEQ ID NO: 2179 - protein, 7 aa, Artificial Sequence
  Description of Artificial Sequence: Synthetic peptide
  XENP019973 vlCDR2
GAFSRAT

SEQ ID NO: 2180 - protein, 9 aa, Artificial Sequence
  Description of Artificial Sequence: Synthetic peptide
  XENP019973 vlCDR3
QQYGSSPWT

SEQ ID NO: 2181 - protein, 246 aa, Artificial Sequence
  Description of Artificial Sequence: Synthetic polypeptide
  XENP019974 [CTLA-4]_H0_L0.86_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLKISRLEPEDFAVYYCQQYGSSPWTFGQGTKVEIK

SEQ ID NO: 2182 - protein, 118 aa, Artificial Sequence; identical to SEQ ID NO: 22
  Description of Artificial Sequence: Synthetic polypeptide
  VH of XENP019974

SEQ ID NO: 2183 - protein, 108 aa, Artificial Sequence
  Description of Artificial Sequence: Synthetic polypeptide
  VL of XENP019974
EIVLTQSPGTLSLSPGERATLSCRASQSVGSSYLAWYQQKPGQAPRLLIYGAFSRATGIPDRFSGSGSGTDFTLKISRLEPEDFAVYYCQQYGSSPWTFGQGTKVEIK

SEQ ID NO: 2184 - protein, 5 aa, Artificial Sequence
  Description of Artificial Sequence: Synthetic peptide
  XENP019974 vhCDR1
SYTMH

SEQ ID NO: 2185 - protein, 17 aa, Artificial Sequence
  Description of Artificial Sequence: Synthetic peptide
  XENP019974 vhCDR2
FISYDGNNKYYADSVKG

SEQ ID NO: 2186 - protein, 9 aa, Artificial Sequence
  Description of Artificial Sequence: Synthetic peptide
  XENP019974 vhCDR3
TGWLGPFDY

SEQ ID NO: 2187 - protein, 12 aa, Artificial Sequence
  Description of Artificial Sequence: Synthetic peptide
  XENP019974 vlCDR1
RASQSVGSSYLA

SEQ ID NO: 2188 - protein, 7 aa, Artificial Sequence
  Description of Artificial Sequence: Synthetic peptide
  XENP019974 vlCDR2
GAFSRAT

SEQ ID NO: 2189 - protein, 9 aa, Artificial Sequence
  Description of Artificial Sequence: Synthetic peptide
  XENP019974 vlCDR3
QQYGSSPWT

SEQ ID NO: 2190 - protein, 246 aa, Artificial Sequence
  Description of Artificial Sequence: Synthetic polypeptide
  XENP019975 [CTLA-4]_H0_L0.87_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISSLEPEDFAVYYCQQYGSSPWTFGQGTKVEIK

SEQ ID NO: 2191 - protein, 118 aa, Artificial Sequence; identical to SEQ ID NO: 22
  Description of Artificial Sequence: Synthetic polypeptide
  VH of XENP019975

SEQ ID NO: 2192 - protein, 108 aa, Artificial Sequence
  Description of Artificial Sequence: Synthetic polypeptide
  VL of XENP019975
EIVLTQSPGTLSLSPGERATLSCRASQSVGSSYLAWYQQKPGQAPRLLIYGAFSRATGIPDRFSGSGSGTDFTLTISSLEPEDFAVYYCQQYGSSPWTFGQGTKVEIK

SEQ ID NO: 2193 - protein, 5 aa, Artificial Sequence
  Description of Artificial Sequence: Synthetic peptide
  XENP019975 vhCDR1
SYTMH

SEQ ID NO: 2194 - protein, 17 aa, Artificial Sequence
  Description of Artificial Sequence: Synthetic peptide
  XENP019975 vhCDR2
FISYDGNNKYYADSVKG

SEQ ID NO: 2195 - protein, 9 aa, Artificial Sequence
  Description of Artificial Sequence: Synthetic peptide
  XENP019975 vhCDR3
TGWLGPFDY

SEQ ID NO: 2196 - protein, 12 aa, Artificial Sequence
  Description of Artificial Sequence: Synthetic peptide
  XENP019975 vlCDR1
RASQSVGSSYLA

SEQ ID NO: 2197 - protein, 7 aa, Artificial Sequence
  Description of Artificial Sequence: Synthetic peptide
  XENP019975 vlCDR2
GAFSRAT

SEQ ID NO: 2198 - protein, 9 aa, Artificial Sequence
  Description of Artificial Sequence: Synthetic peptide
  XENP019975 vlCDR3
QQYGSSPWT

SEQ ID NO: 2199 - protein, 246 aa, Artificial Sequence
  Description of Artificial Sequence: Synthetic polypeptide
  XENP019976 [CTLA-4]_H0_L0.88_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISSLQSEDFAVYYCQQYGSSPWTFGQGTKVEIK

SEQ ID NO: 2200 - protein, 118 aa, Artificial Sequence; identical to SEQ ID NO: 22
  Description of Artificial Sequence: Synthetic polypeptide
  VH of XENP019976

SEQ ID NO: 2201 - protein, 108 aa, Artificial Sequence
  Description of Artificial Sequence: Synthetic polypeptide
  VL of XENP019976
EIVLTQSPGTLSLSPGERATLSCRASQSVGSSYLAWYQQKPGQAPRLLIYGAFSRATGIPDRFSGSGSGTDFTLTISSLQSEDFAVYYCQQYGSSPWTFGQGTKVEIK

SEQ ID NO: 2202 - protein, 5 aa, Artificial Sequence
  Description of Artificial Sequence: Synthetic peptide
  XENP019976 vhCDR1
SYTMH

SEQ ID NO: 2203 - protein, 17 aa, Artificial Sequence
  Description of Artificial Sequence: Synthetic peptide
  XENP019976 vhCDR2
FISYDGNNKYYADSVKG

SEQ ID NO: 2204 - protein, 9 aa, Artificial Sequence
  Description of Artificial Sequence: Synthetic peptide
  XENP019976 vhCDR3
TGWLGPFDY

SEQ ID NO: 2205 - protein, 12 aa, Artificial Sequence
  Description of Artificial Sequence: Synthetic peptide
  XENP019976 vlCDR1
RASQSVGSSYLA

SEQ ID NO: 2206 - protein, 7 aa, Artificial Sequence
  Description of Artificial Sequence: Synthetic peptide
  XENP019976 vlCDR2
GAFSRAT

SEQ ID NO: 2207 - protein, 9 aa, Artificial Sequence
  Description of Artificial Sequence: Synthetic peptide
  XENP019976 vlCDR3
QQYGSSPWT

SEQ ID NO: 2208 - protein, 246 aa, Artificial Sequence
  Description of Artificial Sequence: Synthetic polypeptide
  XENP019977 [CTLA-4]_H0_L0.89_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRVEPEDFAVYYCQQYGSSPWTFGQGTKVEIK

SEQ ID NO: 2209 - protein, 118 aa, Artificial Sequence; identical to SEQ ID NO: 22
  Description of Artificial Sequence: Synthetic polypeptide
  VH of XENP019977

SEQ ID NO: 2210 - protein, 108 aa, Artificial Sequence
  Description of Artificial Sequence: Synthetic polypeptide
  VL of XENP019977
EIVLTQSPGTLSLSPGERATLSCRASQSVGSSYLAWYQQKPGQAPRLLIYGAFSRATGIPDRFSGSGSGTDFTLTISRVEPEDFAVYYCQQYGSSPWTFGQGTKVEIK

SEQ ID NO: 2211 - protein, 5 aa, Artificial Sequence
  Description of Artificial Sequence: Synthetic peptide
  XENP019977 vhCDR1
SYTMH

SEQ ID NO: 2212 - protein, 17 aa, Artificial Sequence
  Description of Artificial Sequence: Synthetic peptide
  XENP019977 vhCDR2
FISYDGNNKYYADSVKG

SEQ ID NO: 2213 - protein, 9 aa, Artificial Sequence
  Description of Artificial Sequence: Synthetic peptide
  XENP019977 vhCDR3
TGWLGPFDY

SEQ ID NO: 2214 - protein, 12 aa, Artificial Sequence
  Description of Artificial Sequence: Synthetic peptide
  XENP019977 vlCDR1
RASQSVGSSYLA

SEQ ID NO: 2215 - protein, 7 aa, Artificial Sequence
  Description of Artificial Sequence: Synthetic peptide
  XENP019977 vlCDR2
GAFSRAT

SEQ ID NO: 2216 - protein, 9 aa, Artificial Sequence
  Description of Artificial Sequence: Synthetic peptide
  XENP019977 vlCDR3
QQYGSSPWT

SEQ ID NO: 2217 - protein, 246 aa, Artificial Sequence
  Description of Artificial Sequence: Synthetic polypeptide
  XENP019978 [CTLA-4]_H0_L0.90_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLQPEDFAVYYCQQYGSSPWTFGQGTKVEIK

SEQ ID NO: 2218 - protein, 118 aa, Artificial Sequence; identical to SEQ ID NO: 22
  Description of Artificial Sequence: Synthetic polypeptide
  VH of XENP019978

SEQ ID NO: 2219 - protein, 108 aa, Artificial Sequence
  Description of Artificial Sequence: Synthetic polypeptide
  VL of XENP019978
EIVLTQSPGTLSLSPGERATLSCRASQSVGSSYLAWYQQKPGQAPRLLIYGAFSRATGIPDRFSGSGSGTDFTLTISRLQPEDFAVYYCQQYGSSPWTFGQGTKVEIK

SEQ ID NO: 2220 - protein, 5 aa, Artificial Sequence
  Description of Artificial Sequence: Synthetic peptide
  XENP019978 vhCDR1
SYTMH

SEQ ID NO: 2221 - protein, 17 aa, Artificial Sequence
  Description of Artificial Sequence: Synthetic peptide
  XENP019978 vhCDR2
FISYDGNNKYYADSVKG

SEQ ID NO: 2222 - protein, 9 aa, Artificial Sequence
  Description of Artificial Sequence: Synthetic peptide
  XENP019978 vhCDR3
TGWLGPFDY

SEQ ID NO: 2223 - protein, 12 aa, Artificial Sequence
  Description of Artificial Sequence: Synthetic peptide
  XENP019978 vlCDR1
RASQSVGSSYLA

SEQ ID NO: 2224 - protein, 7 aa, Artificial Sequence
  Description of Artificial Sequence: Synthetic peptide
  XENP019978 vlCDR2
GAFSRAT

SEQ ID NO: 2225 - protein, 9 aa, Artificial Sequence
  Description of Artificial Sequence: Synthetic peptide
  XENP019978 vlCDR3
QQYGSSPWT

SEQ ID NO: 2226 - protein, 246 aa, Artificial Sequence
  Description of Artificial Sequence: Synthetic polypeptide
  XENP019979 [CTLA-4]_H0_L0.91_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLESEDFAVYYCQQYGSSPWTFGQGTKVEIK

SEQ ID NO: 2227 - protein, 118 aa, Artificial Sequence; identical to SEQ ID NO: 22
  Description of Artificial Sequence: Synthetic polypeptide
  VH of XENP019979

SEQ ID NO: 2228 - protein, 108 aa, Artificial Sequence
  Description of Artificial Sequence: Synthetic polypeptide
  VL of XENP019979
EIVLTQSPGTLSLSPGERATLSCRASQSVGSSYLAWYQQKPGQAPRLLIYGAFSRATGIPDRFSGSGSGTDFTLTISRLESEDFAVYYCQQYGSSPWTFGQGTKVEIK

SEQ ID NO: 2229 - protein, 5 aa, Artificial Sequence
  Description of Artificial Sequence: Synthetic peptide
  XENP019979 vhCDR1
SYTMH

SEQ ID NO: 2230 - protein, 17 aa, Artificial Sequence
  Description of Artificial Sequence: Synthetic peptide
  XENP019979 vhCDR2
FISYDGNNKYYADSVKG

SEQ ID NO: 2231 - protein, 9 aa, Artificial Sequence
  Description of Artificial Sequence: Synthetic peptide
  XENP019979 vhCDR3
TGWLGPFDY

SEQ ID NO: 2232 - protein, 12 aa, Artificial Sequence
  Description of Artificial Sequence: Synthetic peptide
  XENP019979 vlCDR1
RASQSVGSSYLA

SEQ ID NO: 2233 - protein, 7 aa, Artificial Sequence
  Description of Artificial Sequence: Synthetic peptide
  XENP019979 vlCDR2
GAFSRAT

SEQ ID NO: 2234 - protein, 9 aa, Artificial Sequence
  Description of Artificial Sequence: Synthetic peptide
  XENP019979 vlCDR3
QQYGSSPWT

SEQ ID NO: 2235 - protein, 246 aa, Artificial Sequence
  Description of Artificial Sequence: Synthetic polypeptide
  XENP019980 [CTLA-4]_H0_L0.92_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPQDFAVYYCQQYGSSPWTFGQGTKVEIK

SEQ ID NO: 2236 - protein, 118 aa, Artificial Sequence; identical to SEQ ID NO: 22
  Description of Artificial Sequence: Synthetic polypeptide
  VH of XENP019980

SEQ ID NO: 2237 - protein, 108 aa, Artificial Sequence
  Description of Artificial Sequence: Synthetic polypeptide
  VL of XENP019980
EIVLTQSPGTLSLSPGERATLSCRASQSVGSSYLAWYQQKPGQAPRLLIYGAFSRATGIPDRFSGSGSGTDFTLTISRLEPQDFAVYYCQQYGSSPWTFGQGTKVEIK

SEQ ID NO: 2238 - protein, 5 aa, Artificial Sequence
  Description of Artificial Sequence: Synthetic peptide
  XENP019980 vhCDR1
SYTMH

SEQ ID NO: 2239 - protein, 17 aa, Artificial Sequence
  Description of Artificial Sequence: Synthetic peptide
  XENP019980 vhCDR2
FISYDGNNKYYADSVKG

SEQ ID NO: 2240 - protein, 9 aa, Artificial Sequence
  Description of Artificial Sequence: Synthetic peptide
  XENP019980 vhCDR3
TGWLGPFDY

SEQ ID NO: 2241 - protein, 12 aa, Artificial Sequence
  Description of Artificial Sequence: Synthetic peptide
  XENP019980 vlCDR1
RASQSVGSSYLA

SEQ ID NO: 2242 - protein, 7 aa, Artificial Sequence
  Description of Artificial Sequence: Synthetic peptide
  XENP019980 vlCDR2
GAFSRAT

SEQ ID NO: 2243 - protein, 9 aa, Artificial Sequence
  Description of Artificial Sequence: Synthetic peptide
  XENP019980 vlCDR3
QQYGSSPWT

SEQ ID NO: 2244 - protein, 246 aa, Artificial Sequence
  Description of Artificial Sequence: Synthetic polypeptide
  XENP019981 [CTLA-4]_H0_L0.93_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCKQYGSSPWTFGQGTKVEIK

SEQ ID NO: 2245 - protein, 118 aa, Artificial Sequence; identical to SEQ ID NO: 22
  Description of Artificial Sequence: Synthetic polypeptide
  VH of XENP019981

SEQ ID NO: 2246 - protein, 108 aa, Artificial Sequence
  Description of Artificial Sequence: Synthetic polypeptide
  VL of XENP019981
EIVLTQSPGTLSLSPGERATLSCRASQSVGSSYLAWYQQKPGQAPRLLIYGAFSRATGIPDRFSGSGSGTDFTLTISRLEPEDFAVYYCKQYGSSPWTFGQGTKVEIK

SEQ ID NO: 2247 - protein, 5 aa, Artificial Sequence
  Description of Artificial Sequence: Synthetic peptide
  XENP019981 vhCDR1
SYTMH

SEQ ID NO: 2248 - protein, 17 aa, Artificial Sequence
  Description of Artificial Sequence: Synthetic peptide
  XENP019981 vhCDR2
FISYDGNNKYYADSVKG

SEQ ID NO: 2249 - protein, 9 aa, Artificial Sequence
  Description of Artificial Sequence: Synthetic peptide
  XENP019981 vhCDR3
TGWLGPFDY

SEQ ID NO: 2250 - protein, 12 aa, Artificial Sequence
  Description of Artificial Sequence: Synthetic peptide
  XENP019981 vlCDR1
RASQSVGSSYLA

SEQ ID NO: 2251 - protein, 7 aa, Artificial Sequence
  Description of Artificial Sequence: Synthetic peptide
  XENP019981 vlCDR2
GAFSRAT

SEQ ID NO: 2252 - protein, 9 aa, Artificial Sequence
  Description of Artificial Sequence: Synthetic peptide
  XENP019981 vlCDR3
KQYGSSPWT

SEQ ID NO: 2253 - protein, 246 aa, Artificial Sequence
  Description of Artificial Sequence: Synthetic polypeptide
  XENP019982 [CTLA-4]_H0_L0.94_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCLQYGSSPWTFGQGTKVEIK

SEQ ID NO: 2254 - protein, 118 aa, Artificial Sequence; identical to SEQ ID NO: 22
  Description of Artificial Sequence: Synthetic polypeptide
  VH of XENP019982

SEQ ID NO: 2255 - protein, 108 aa, Artificial Sequence
  Description of Artificial Sequence: Synthetic polypeptide
  VL of XENP019982
EIVLTQSPGTLSLSPGERATLSCRASQSVGSSYLAWYQQKPGQAPRLLIYGAFSRATGIPDRFSGSGSGTDFTLTISRLEPEDFAVYYCLQYGSSPWTFGQGTKVEIK

SEQ ID NO: 2256 - protein, 5 aa, Artificial Sequence
  Description of Artificial Sequence: Synthetic peptide
  XENP019982 vhCDR1
SYTMH

SEQ ID NO: 2257 - protein, 17 aa, Artificial Sequence
  Description of Artificial Sequence: Synthetic peptide
  XENP019982 vhCDR2
FISYDGNNKYYADSVKG

SEQ ID NO: 2258 - protein, 9 aa, Artificial Sequence
  Description of Artificial Sequence: Synthetic peptide
  XENP019982 vhCDR3
TGWLGPFDY

SEQ ID NO: 2259 - protein, 12 aa, Artificial Sequence
  Description of Artificial Sequence: Synthetic peptide
  XENP019982 vlCDR1
RASQSVGSSYLA

SEQ ID NO: 2260 - protein, 7 aa, Artificial Sequence
  Description of Artificial Sequence: Synthetic peptide
  XENP019982 vlCDR2
GAFSRAT

SEQ ID NO: 2261 - protein, 9 aa, Artificial Sequence
  Description of Artificial Sequence: Synthetic peptide
  XENP019982 vlCDR3
LQYGSSPWT

SEQ ID NO: 2262 - protein, 246 aa, Artificial Sequence
  Description of Artificial Sequence: Synthetic polypeptide
  XENP019983 [CTLA-4]_H0_L0.95_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCMQYGSSPWTFGQGTKVEIK

SEQ ID NO: 2263 - protein, 118 aa, Artificial Sequence; identical to SEQ ID NO: 22
  Description of Artificial Sequence: Synthetic polypeptide
  VH of XENP019983

SEQ ID NO: 2264 - protein, 108 aa, Artificial Sequence
  Description of Artificial Sequence: Synthetic polypeptide
  VL of XENP019983
EIVLTQSPGTLSLSPGERATLSCRASQSVGSSYLAWYQQKPGQAPRLLIYGAFSRATGIPDRFSGSGSGTDFTLTISRLEPEDFAVYYCMQYGSSPWTFGQGTKVEIK

SEQ ID NO: 2265 - protein, 5 aa, Artificial Sequence
  Description of Artificial Sequence: Synthetic peptide
  XENP019983 vhCDR1
SYTMH

SEQ ID NO: 2266 - protein, 17 aa, Artificial Sequence
  Description of Artificial Sequence: Synthetic peptide
  XENP019983 vhCDR2
FISYDGNNKYYADSVKG

SEQ ID NO: 2267 - protein, 9 aa, Artificial Sequence
  Description of Artificial Sequence: Synthetic peptide
  XENP019983 vhCDR3
TGWLGPFDY

SEQ ID NO: 2268 - protein, 12 aa, Artificial Sequence
  Description of Artificial Sequence: Synthetic peptide
  XENP019983 vlCDR1
RASQSVGSSYLA

SEQ ID NO: 2269 - protein, 7 aa, Artificial Sequence
  Description of Artificial Sequence: Synthetic peptide
  XENP019983 vlCDR2
GAFSRAT

SEQ ID NO: 2270 - protein, 9 aa, Artificial Sequence
  Description of Artificial Sequence: Synthetic peptide
  XENP019983 vlCDR3
MQYGSSPWT

SEQ ID NO: 2271 - protein, 246 aa, Artificial Sequence
  Description of Artificial Sequence: Synthetic polypeptide
  XENP019984 [CTLA-4]_H0_L0.96_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQSYGSSPWTFGQGTKVEIK

SEQ ID NO: 2272 - protein, 118 aa, Artificial Sequence; identical to SEQ ID NO: 22
  Description of Artificial Sequence: Synthetic polypeptide
  VH of XENP019984

SEQ ID NO: 2273 - protein, 108 aa, Artificial Sequence
  Description of Artificial Sequence: Synthetic polypeptide
  VL of XENP019984
EIVLTQSPGTLSLSPGERATLSCRASQSVGSSYLAWYQQKPGQAPRLLIYGAFSRATGIPDRFSGSGSGTDFTLTISRLEPEDFAVYYCQSYGSSPWTFGQGTKVEIK

SEQ ID NO: 2274 - protein, 5 aa, Artificial Sequence
  Description of Artificial Sequence: Synthetic peptide
  XENP019984 vhCDR1
SYTMH

SEQ ID NO: 2275 - protein, 17 aa, Artificial Sequence
  Description of Artificial Sequence: Synthetic peptide
  XENP019984 vhCDR2
FISYDGNNKYYADSVKG

SEQ ID NO: 2276 - protein, 9 aa, Artificial Sequence
  Description of Artificial Sequence: Synthetic peptide
  XENP019984 vhCDR3
TGWLGPFDY

SEQ ID NO: 2277 - protein, 12 aa, Artificial Sequence
  Description of Artificial Sequence: Synthetic peptide
  XENP019984 vlCDR1
RASQSVGSSYLA

SEQ ID NO: 2278 - protein, 7 aa, Artificial Sequence
  Description of Artificial Sequence: Synthetic peptide
  XENP019984 vlCDR2
GAFSRAT

SEQ ID NO: 2279 - protein, 9 aa, Artificial Sequence
  Description of Artificial Sequence: Synthetic peptide
  XENP019984 vlCDR3
QSYGSSPWT

SEQ ID NO: 2280 - protein, 246 aa, Artificial Sequence
  Description of Artificial Sequence: Synthetic polypeptide
  XENP019985 [CTLA-4]_H0_L0.97_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQAGSSPWTFGQGTKVEIK

SEQ ID NO: 2281 - protein, 118 aa, Artificial Sequence; identical to SEQ ID NO: 22
  Description of Artificial Sequence: Synthetic polypeptide
  VH of XENP019985

SEQ ID NO: 2282 - protein, 108 aa, Artificial Sequence
  Description of Artificial Sequence: Synthetic polypeptide
  VL of XENP019985
EIVLTQSPGTLSLSPGERATLSCRASQSVGSSYLAWYQQKPGQAPRLLIYGAFSRATGIPDRFSGSGSGTDFTLTISRLEPEDFAVYYCQQAGSSPWTFGQGTKVEIK

SEQ ID NO: 2283 - protein, 5 aa, Artificial Sequence
  Description of Artificial Sequence: Synthetic peptide
  XENP019985 vhCDR1
SYTMH

SEQ ID NO: 2284 - protein, 17 aa, Artificial Sequence
  Description of Artificial Sequence: Synthetic peptide
  XENP019985 vhCDR2
FISYDGNNKYYADSVKG

SEQ ID NO: 2285 - protein, 9 aa, Artificial Sequence
  Description of Artificial Sequence: Synthetic peptide
  XENP019985 vhCDR3
TGWLGPFDY

SEQ ID NO: 2286 - protein, 12 aa, Artificial Sequence
  Description of Artificial Sequence: Synthetic peptide
  XENP019985 vlCDR1
RASQSVGSSYLA

SEQ ID NO: 2287 - protein, 7 aa, Artificial Sequence
  Description of Artificial Sequence: Synthetic peptide
  XENP019985 vlCDR2
GAFSRAT

SEQ ID NO: 2288 - protein, 9 aa, Artificial Sequence
  Description of Artificial Sequence: Synthetic peptide
  XENP019985 vlCDR3
QQAGSSPWT

SEQ ID NO: 2289 - protein, 246 aa, Artificial Sequence
  Description of Artificial Sequence: Synthetic polypeptide
  XENP019986 [CTLA-4]_H0_L0.98_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQFGSSPWTFGQGTKVEIK

SEQ ID NO: 2290 - protein, 118 aa, Artificial Sequence; identical to SEQ ID NO: 22
  Description of Artificial Sequence: Synthetic polypeptide
  VH of XENP019986

SEQ ID NO: 2291 - protein, 108 aa, Artificial Sequence
  Description of Artificial Sequence: Synthetic polypeptide
  VL of XENP019986
EIVLTQSPGTLSLSPGERATLSCRASQSVGSSYLAWYQQKPGQAPRLLIYGAFSRATGIPDRFSGSGSGTDFTLTISRLEPEDFAVYYCQQFGSSPWTFGQGTKVEIK

SEQ ID NO: 2292 - protein, 5 aa, Artificial Sequence
  Description of Artificial Sequence: Synthetic peptide
  XENP019986 vhCDR1
SYTMH

SEQ ID NO: 2293 - protein, 17 aa, Artificial Sequence
  Description of Artificial Sequence: Synthetic peptide
  XENP019986 vhCDR2
FISYDGNNKYYADSVKG

SEQ ID NO: 2294 - protein, 9 aa, Artificial Sequence
  Description of Artificial Sequence: Synthetic peptide
  XENP019986 vhCDR3
TGWLGPFDY

SEQ ID NO: 2295 - protein, 12 aa, Artificial Sequence
  Description of Artificial Sequence: Synthetic peptide
  XENP019986 vlCDR1
RASQSVGSSYLA

SEQ ID NO: 2296 - protein, 7 aa, Artificial Sequence
  Description of Artificial Sequence: Synthetic peptide
  XENP019986 vlCDR2
GAFSRAT

SEQ ID NO: 2297 - protein, 9 aa, Artificial Sequence
  Description of Artificial Sequence: Synthetic peptide
  XENP019986 vlCDR3
QQFGSSPWT

SEQ ID NO: 2298 - protein, 246 aa, Artificial Sequence
  Description of Artificial Sequence: Synthetic polypeptide
  XENP019987 [CTLA-4]_H0_L0.99_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQHGSSPWTFGQGTKVEIK

SEQ ID NO: 2299 - protein, 118 aa, Artificial Sequence; identical to SEQ ID NO: 22
  Description of Artificial Sequence: Synthetic polypeptide
  VH of XENP019987

SEQ ID NO: 2300 - protein, 108 aa, Artificial Sequence
  Description of Artificial Sequence: Synthetic polypeptide
  VL of XENP019987
EIVLTQSPGTLSLSPGERATLSCRASQSVGSSYLAWYQQKPGQAPRLLIYGAFSRATGIPDRFSGSGSGTDFTLTISRLEPEDFAVYYCQQHGSSPWTFGQGTKVEIK

SEQ ID NO: 2301 - protein, 5 aa, Artificial Sequence
  Description of Artificial Sequence: Synthetic peptide
  XENP019987 vhCDR1
SYTMH

SEQ ID NO: 2302 - protein, 17 aa, Artificial Sequence
  Description of Artificial Sequence: Synthetic peptide
  XENP019987 vhCDR2
FISYDGNNKYYADSVKG

SEQ ID NO: 2303 - protein, 9 aa, Artificial Sequence
  Description of Artificial Sequence: Synthetic peptide
  XENP019987 vhCDR3
TGWLGPFDY

SEQ ID NO: 2304 - protein, 12 aa, Artificial Sequence
  Description of Artificial Sequence: Synthetic peptide
  XENP019987 vlCDR1
RASQSVGSSYLA

SEQ ID NO: 2305 - protein, 7 aa, Artificial Sequence
  Description of Artificial Sequence: Synthetic peptide
  XENP019987 vlCDR2
GAFSRAT

SEQ ID NO: 2306 - protein, 9 aa, Artificial Sequence
  Description of Artificial Sequence: Synthetic peptide
  XENP019987 vlCDR3
QQHGSSPWT

SEQ ID NO: 2307 - protein, 246 aa, Artificial Sequence
  Description of Artificial Sequence: Synthetic polypeptide
  XENP019988 [CTLA-4]_H0_L0.100_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQLGSSPWTFGQGTKVEIK

SEQ ID NO: 2308 - protein, 118 aa, Artificial Sequence; identical to SEQ ID NO: 22
  Description of Artificial Sequence: Synthetic polypeptide
  VH of XENP019988

SEQ ID NO: 2309 - protein, 108 aa, Artificial Sequence
  Description of Artificial Sequence: Synthetic polypeptide
  VL of XENP019988
EIVLTQSPGTLSLSPGERATLSCRASQSVGSSYLAWYQQKPGQAPRLLIYGAFSRATGIPDRFSGSGSGTDFTLTISRLEPEDFAVYYCQQLGSSPWTFGQGTKVEIK

SEQ ID NO: 2310 - protein, 5 aa, Artificial Sequence
  Description of Artificial Sequence: Synthetic peptide
  XENP019988 vhCDR1
SYTMH

SEQ ID NO: 2311 - protein, 17 aa, Artificial Sequence
  Description of Artificial Sequence: Synthetic peptide
  XENP019988 vhCDR2
FISYDGNNKYYADSVKG

SEQ ID NO: 2312 - protein, 9 aa, Artificial Sequence
  Description of Artificial Sequence: Synthetic peptide
  XENP019988 vhCDR3
TGWLGPFDY

SEQ ID NO: 2313 - protein, 12 aa, Artificial Sequence
  Description of Artificial Sequence: Synthetic peptide
  XENP019988 vlCDR1
RASQSVGSSYLA

SEQ ID NO: 2314 - protein, 7 aa, Artificial Sequence
  Description of Artificial Sequence: Synthetic peptide
  XENP019988 vlCDR2
GAFSRAT

SEQ ID NO: 2315 - protein, 9 aa, Artificial Sequence
  Description of Artificial Sequence: Synthetic peptide
  XENP019988 vlCDR3
QQLGSSPWT

SEQ ID NO: 2316 - protein, 246 aa, Artificial Sequence
  Description of Artificial Sequence: Synthetic polypeptide
  XENP019989 [CTLA-4]_H0_L0.101_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQVGSSPWTFGQGTKVEIK

SEQ ID NO: 2317 - protein, 118 aa, Artificial Sequence; identical to SEQ ID NO: 22
  Description of Artificial Sequence: Synthetic polypeptide
  VH of XENP019989

SEQ ID NO: 2318 - protein, 108 aa, Artificial Sequence
  Description of Artificial Sequence: Synthetic polypeptide
  VL of XENP019989
EIVLTQSPGTLSLSPGERATLSCRASQSVGSSYLAWYQQKPGQAPRLLIYGAFSRATGIPDRFSGSGSGTDFTLTISRLEPEDFAVYYCQQVGSSPWTFGQGTKVEIK

SEQ ID NO: 2319 - protein, 5 aa, Artificial Sequence
  Description of Artificial Sequence: Synthetic peptide
  XENP019989 vhCDR1
SYTMH

SEQ ID NO: 2320 - protein, 17 aa, Artificial Sequence
  Description of Artificial Sequence: Synthetic peptide
  XENP019989 vhCDR2
FISYDGNNKYYADSVKG

SEQ ID NO: 2321 - protein, 9 aa, Artificial Sequence
  Description of Artificial Sequence: Synthetic peptide
  XENP019989 vhCDR3
TGWLGPFDY

SEQ ID NO: 2322 - protein, 12 aa, Artificial Sequence
  Description of Artificial Sequence: Synthetic peptide
  XENP019989 vlCDR1
RASQSVGSSYLA

SEQ ID NO: 2323 - protein, 7 aa, Artificial Sequence
  Description of Artificial Sequence: Synthetic peptide
  XENP019989 vlCDR2
GAFSRAT

SEQ ID NO: 2324 - protein, 9 aa, Artificial Sequence
  Description of Artificial Sequence: Synthetic peptide
  XENP019989 vlCDR3
QQVGSSPWT

SEQ ID NO: 2325 - protein, 246 aa, Artificial Sequence
  Description of Artificial Sequence: Synthetic polypeptide
  XENP019990 [CTLA-4]_H0_L0.102_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGESPWTFGQGTKVEIK

SEQ ID NO: 2326 - protein, 118 aa, Artificial Sequence; identical to SEQ ID NO: 22
  Description of Artificial Sequence: Synthetic polypeptide
  VH of XENP019990

SEQ ID NO: 2327 - protein, 108 aa, Artificial Sequence
  Description of Artificial Sequence: Synthetic polypeptide
  VL of XENP019990
EIVLTQSPGTLSLSPGERATLSCRASQSVGSSYLAWYQQKPGQAPRLLIYGAFSRATGIPDRFSGSGSGTDFTLTISRLEPEDFAVYYCQQYGESPWTFGQGTKVEIK

SEQ ID NO: 2328 - protein, 5 aa, Artificial Sequence
  Description of Artificial Sequence: Synthetic peptide
  XENP019990 vhCDR1
SYTMH

SEQ ID NO: 2329 - protein, 17 aa, Artificial Sequence
  Description of Artificial Sequence: Synthetic peptide
  XENP019990 vhCDR2
FISYDGNNKYYADSVKG

SEQ ID NO: 2330 - protein, 9 aa, Artificial Sequence
  Description of Artificial Sequence: Synthetic peptide
  XENP019990 vhCDR3
TGWLGPFDY

SEQ ID NO: 2331 - protein, 12 aa, Artificial Sequence
  Description of Artificial Sequence: Synthetic peptide
  XENP019990 vlCDR1
RASQSVGSSYLA

SEQ ID NO: 2332 - protein, 7 aa, Artificial Sequence
  Description of Artificial Sequence: Synthetic peptide
  XENP019990 vlCDR2
GAFSRAT

SEQ ID NO: 2333 - protein, 9 aa, Artificial Sequence
  Description of Artificial Sequence: Synthetic peptide
  XENP019990 vlCDR3
QQYGESPWT

SEQ ID NO: 2334 - protein, 246 aa, Artificial Sequence
  Description of Artificial Sequence: Synthetic polypeptide
  XENP019991 [CTLA-4]_H0_L0.103_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGKSPWTFGQGTKVEIK

SEQ ID NO: 2335 - protein, 118 aa, Artificial Sequence; identical to SEQ ID NO: 22
  Description of Artificial Sequence: Synthetic polypeptide
  VH of XENP019991

SEQ ID NO: 2336 - protein, 108 aa, Artificial Sequence
  Description of Artificial Sequence: Synthetic polypeptide
  VL of XENP019991
EIVLTQSPGTLSLSPGERATLSCRASQSVGSSYLAWYQQKPGQAPRLLIYGAFSRATGIPDRFSGSGSGTDFTLTISRLEPEDFAVYYCQQYGKSPWTFGQGTKVEIK

SEQ ID NO: 2337 - protein, 5 aa, Artificial Sequence
  Description of Artificial Sequence: Synthetic peptide
  XENP019991 vhCDR1
SYTMH

SEQ ID NO: 2338 - protein, 17 aa, Artificial Sequence
  Description of Artificial Sequence: Synthetic peptide
  XENP019991 vhCDR2
FISYDGNNKYYADSVKG

SEQ ID NO: 2339 - protein, 9 aa, Artificial Sequence
  Description of Artificial Sequence: Synthetic peptide
  XENP019991 vhCDR3
TGWLGPFDY

SEQ ID NO: 2340 - protein, 12 aa, Artificial Sequence
  Description of Artificial Sequence: Synthetic peptide
  XENP019991 vlCDR1
RASQSVGSSYLA

SEQ ID NO: 2341 - protein, 7 aa, Artificial Sequence
  Description of Artificial Sequence: Synthetic peptide
  XENP019991 vlCDR2
GAFSRAT

SEQ ID NO: 2342 - protein, 9 aa, Artificial Sequence
  Description of Artificial Sequence: Synthetic peptide
  XENP019991 vlCDR3
QQYGKSPWT

SEQ ID NO: 2343 - protein, 246 aa, Artificial Sequence
  Description of Artificial Sequence: Synthetic polypeptide
  XENP019992 [CTLA-4]_H0_L0.104_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSYPWTFGQGTKVEIK

SEQ ID NO: 2344 - protein, 118 aa, Artificial Sequence; identical to SEQ ID NO: 22
  Description of Artificial Sequence: Synthetic polypeptide
  VH of XENP019992

SEQ ID NO: 2345 - protein, 108 aa, Artificial Sequence
  Description of Artificial Sequence: Synthetic polypeptide
  VL of XENP019992
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSYPWTFGQGTKVEIK

SEQ ID NO: 2346 - protein, 5 aa, Artificial Sequence
  Description of Artificial Sequence: Synthetic peptide
  XENP019992 vhCDR1
SYTMH

SEQ ID NO: 2347 - protein, 17 aa, Artificial Sequence
  Description of Artificial Sequence: Synthetic peptide
  XENP019992 vhCDR2
FISYDGNNKYYADSVKG

SEQ ID NO: 2348 - protein, 9 aa, Artificial Sequence
  Description of Artificial Sequence: Synthetic peptide
  XENP019992 vhCDR3
TGWLGPFDY

SEQ ID NO: 2349 - protein, 12 aa, Artificial Sequence
  Description of Artificial Sequence: Synthetic peptide
  XENP019992 vlCDR1
RASQSVGSSYLA

SEQ ID NO: 2350 - protein, 7 aa, Artificial Sequence
  Description of Artificial Sequence: Synthetic peptide
  XENP019992 vlCDR2
GAFSRAT

SEQ ID NO: 2351 - protein, 9 aa, Artificial Sequence
  Description of Artificial Sequence: Synthetic peptide
  XENP019992 vlCDR3
QQYGSYPWT

SEQ ID NO: 2352 - protein, 246 aa, Artificial Sequence
  Description of Artificial Sequence: Synthetic polypeptide
  XENP019993 [CTLA-4]_H0_L0.105_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSHWTFGQGTKVEIK

SEQ ID NO: 2353 - protein, 118 aa, Artificial Sequence; identical to SEQ ID NO: 22
  Description of Artificial Sequence: Synthetic polypeptide
  VH of XENP019993

SEQ ID NO: 2354 - protein, 108 aa, Artificial Sequence
  Description of Artificial Sequence: Synthetic polypeptide
  VL of XENP019993
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSHWTFGQGTKVEIK

SEQ ID NO: 2355 - protein, 5 aa, Artificial Sequence
  Description of Artificial Sequence: Synthetic peptide
  XENP019993 vhCDR1
SYTMH

SEQ ID NO: 2356 - protein, 17 aa, Artificial Sequence
  Description of Artificial Sequence: Synthetic peptide
  XENP019993 vhCDR2
FISYDGNNKYYADSVKG

SEQ ID NO: 2357 - protein, 9 aa, Artificial Sequence
  Description of Artificial Sequence: Synthetic peptide
  XENP019993 vhCDR3
TGWLGPFDY

SEQ ID NO: 2358 - protein, 12 aa, Artificial Sequence
  Description of Artificial Sequence: Synthetic peptide
  XENP019993 vlCDR1
RASQSVGSSYLA

SEQ ID NO: 2359 - protein, 7 aa, Artificial Sequence
  Description of Artificial Sequence: Synthetic peptide
  XENP019993 vlCDR2
GAFSRAT

SEQ ID NO: 2360 - protein, 9 aa, Artificial Sequence
  Description of Artificial Sequence: Synthetic peptide
  XENP019993 vlCDR3
QQYGSSHWT

SEQ ID NO: 2361 - protein, 246 aa, Artificial Sequence
  Description of Artificial Sequence: Synthetic polypeptide
  XENP019994 [CTLA-4]_H0_L0.106_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPFTFGQGTKVEIK

SEQ ID NO: 2362 - protein, 118 aa, Artificial Sequence; identical to SEQ ID NO: 22
  Description of Artificial Sequence: Synthetic polypeptide
  VH of XENP019994

SEQ ID NO: 2363 - protein, 108 aa, Artificial Sequence
  Description of Artificial Sequence: Synthetic polypeptide
  VL of XENP019994
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPFTFGQGTKVEIK

SEQ ID NO: 2364 - protein, 5 aa, Artificial Sequence
  Description of Artificial Sequence: Synthetic peptide
  XENP019994 vhCDR1
SYTMH

SEQ ID NO: 2365 - protein, 17 aa, Artificial Sequence
  Description of Artificial Sequence: Synthetic peptide
  XENP019994 vhCDR2
FISYDGNNKYYADSVKG

SEQ ID NO: 2366 - protein, 9 aa, Artificial Sequence
  Description of Artificial Sequence: Synthetic peptide
  XENP019994 vhCDR3
TGWLGPFDY

SEQ ID NO: 2367 - protein, 12 aa, Artificial Sequence
  Description of Artificial Sequence: Synthetic peptide
  XENP019994 vlCDR1
RASQSVGSSYLA

SEQ ID NO: 2368 - protein, 7 aa, Artificial Sequence
  Description of Artificial Sequence: Synthetic peptide
  XENP019994 vlCDR2
GAFSRAT

SEQ ID NO: 2369 - protein, 9 aa, Artificial Sequence
  Description of Artificial Sequence: Synthetic peptide
  XENP019994 vlCDR3
QQYGSSPFT

SEQ ID NO: 2370 - protein, 246 aa, Artificial Sequence
  Description of Artificial Sequence: Synthetic polypeptide
  XENP019995 [CTLA-4]_H0_L0.107_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPHTFGQGTKVEIK

SEQ ID NO: 2371 - protein, 118 aa, Artificial Sequence; identical to SEQ ID NO: 22
  Description of Artificial Sequence: Synthetic polypeptide
  VH of XENP019995

SEQ ID NO: 2372 - protein, 108 aa, Artificial Sequence
  Description of Artificial Sequence: Synthetic polypeptide
  VL of XENP019995
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPHTFGQGTKVEIK

SEQ ID NO: 2373 - protein, 5 aa, Artificial Sequence
  Description of Artificial Sequence: Synthetic peptide
  XENP019995 vhCDR1
SYTMH

SEQ ID NO: 2374 - protein, 17 aa, Artificial Sequence
  Description of Artificial Sequence: Synthetic peptide
  XENP019995 vhCDR2
FISYDGNNKYYADSVKG

SEQ ID NO: 2375 - protein, 9 aa, Artificial Sequence
  Description of Artificial Sequence: Synthetic peptide
  XENP019995 vhCDR3
TGWLGPFDY

SEQ ID NO: 2376 - protein, 12 aa, Artificial Sequence
  Description of Artificial Sequence: Synthetic peptide
  XENP019995 vlCDR1
RASQSVGSSYLA

SEQ ID NO: 2377 - protein, 7 aa, Artificial Sequence
  Description of Artificial Sequence: Synthetic peptide
  XENP019995 vlCDR2
GAFSRAT

SEQ ID NO: 2378 - protein, 9 aa, Artificial Sequence
  Description of Artificial Sequence: Synthetic peptide
  XENP019995 vlCDR3
QQYGSSPHT

SEQ ID NO: 2379 - protein, 246 aa, Artificial Sequence
  Description of Artificial Sequence: Synthetic polypeptide
  XENP019996 [CTLA-4]_H0_L0.108_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPITFGQGTKVEIK

SEQ ID NO: 2380 - protein, 118 aa, Artificial Sequence; identical to SEQ ID NO: 22
  Description of Artificial Sequence: Synthetic polypeptide
  VH of XENP019996

SEQ ID NO: 2381 - protein, 108 aa, Artificial Sequence
  Description of Artificial Sequence: Synthetic polypeptide
  VL of XENP019996
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPITFGQGTKVEIK

SEQ ID NO: 2382 - protein, 5 aa, Artificial Sequence
  Description of Artificial Sequence: Synthetic peptide
  XENP019996 vhCDR1
SYTMH

SEQ ID NO: 2383 - protein, 17 aa, Artificial Sequence
  Description of Artificial Sequence: Synthetic peptide
  XENP019996 vhCDR2
FISYDGNNKYYADSVKG

SEQ ID NO: 2384 - protein, 9 aa, Artificial Sequence
  Description of Artificial Sequence: Synthetic peptide
  XENP019996 vhCDR3
TGWLGPFDY

SEQ ID NO: 2385 - protein, 12 aa, Artificial Sequence
  Description of Artificial Sequence: Synthetic peptide
  XENP019996 vlCDR1
RASQSVGSSYLA

SEQ ID NO: 2386 - protein, 7 aa, Artificial Sequence
  Description of Artificial Sequence: Synthetic peptide
  XENP019996 vlCDR2
GAFSRAT

SEQ ID NO: 2387 - protein, 9 aa, Artificial Sequence
  Description of Artificial Sequence: Synthetic peptide
  XENP019996 vlCDR3
QQYGSSPIT

SEQ ID NO: 2388 - protein, 246 aa, Artificial Sequence
  Description of Artificial Sequence: Synthetic polypeptide
  XENP020001 [CTLA-4]_H0_L0.109_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPLTFGQGTKVEIK

SEQ ID NO: 2389 - protein, 118 aa, Artificial Sequence; identical to SEQ ID NO: 22
  Description of Artificial Sequence: Synthetic polypeptide
  VH of XENP020001

SEQ ID NO: 2390 - protein, 108 aa, Artificial Sequence
  Description of Artificial Sequence: Synthetic polypeptide
  VL of XENP020001
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPLTFGQGTKVEIK

SEQ ID NO: 2391 - protein, 5 aa, Artificial Sequence
  Description of Artificial Sequence: Synthetic peptide
  XENP020001 vhCDR1
SYTMH

SEQ ID NO: 2392 - protein, 17 aa, Artificial Sequence
  Description of Artificial Sequence: Synthetic peptide
  XENP020001 vhCDR2
FISYDGNNKYYADSVKG

SEQ ID NO: 2393 - protein, 9 aa, Artificial Sequence
  Description of Artificial Sequence: Synthetic peptide
  XENP020001 vhCDR3
TGWLGPFDY

SEQ ID NO: 2394 - protein, 12 aa, Artificial Sequence
  Description of Artificial Sequence: Synthetic peptide
  XENP020001 vlCDR1
RASQSVGSSYLA

SEQ ID NO: 2395 - protein, 7 aa, Artificial Sequence
  Description of Artificial Sequence: Synthetic peptide
  XENP020001 vlCDR2
GAFSRAT

SEQ ID NO: 2396 - protein, 9 aa, Artificial Sequence
  Description of Artificial Sequence: Synthetic peptide
  XENP020001 vlCDR3
QQYGSSPLT

SEQ ID NO: 2397 - protein, 246 aa, Artificial Sequence
  Description of Artificial Sequence: Synthetic polypeptide
  XENP020002 [CTLA-4]_H0_L0.110_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPYTFGQGTKVEIK

SEQ ID NO: 2398 - protein, 118 aa, Artificial Sequence; identical to SEQ ID NO: 22
  Description of Artificial Sequence: Synthetic polypeptide
  VH of XENP020002

SEQ ID NO: 2399 - protein, 108 aa, Artificial Sequence
  Description of Artificial Sequence: Synthetic polypeptide
  VL of XENP020002
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPYTFGQGTKVEIK

SEQ ID NO: 2400 - protein, 5 aa, Artificial Sequence
  Description of Artificial Sequence: Synthetic peptide
  XENP020002 vhCDR1
SYTMH

SEQ ID NO: 2401 - protein, 17 aa, Artificial Sequence
  Description of Artificial Sequence: Synthetic peptide
  XENP020002 vhCDR2
FISYDGNNKYYADSVKG

SEQ ID NO: 2402 - protein, 9 aa, Artificial Sequence
  Description of Artificial Sequence: Synthetic peptide
  XENP020002 vhCDR3
TGWLGPFDY

SEQ ID NO: 2403 - protein, 12 aa, Artificial Sequence
  Description of Artificial Sequence: Synthetic peptide
  XENP020002 vlCDR1
RASQSVGSSYLA

SEQ ID NO: 2404 - protein, 7 aa, Artificial Sequence
  Description of Artificial Sequence: Synthetic peptide
  XENP020002 vlCDR2
GAFSRAT

SEQ ID NO: 2405 - protein, 9 aa, Artificial Sequence
  Description of Artificial Sequence: Synthetic peptide
  XENP020002 vlCDR3
QQYGSSPYT

SEQ ID NO: 2406 - protein, 246 aa, Artificial Sequence
  Description of Artificial Sequence: Synthetic polypeptide
  XENP020003 [CTLA-4]_H0_L0.111_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWVFGQGTKVEIK

SEQ ID NO: 2407 - protein, 118 aa, Artificial Sequence; identical to SEQ ID NO: 22
  Description of Artificial Sequence: Synthetic polypeptide
  VH of XENP020003

SEQ ID NO: 2408 - protein, 108 aa, Artificial Sequence
  Description of Artificial Sequence: Synthetic polypeptide
  VL of XENP020003
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWVFGQGTKVEIK

SEQ ID NO: 2409 - protein, 5 aa, Artificial Sequence
  Description of Artificial Sequence: Synthetic peptide
  XENP020003 vhCDR1
SYTMH

SEQ ID NO: 2410 - protein, 17 aa, Artificial Sequence
  Description of Artificial Sequence: Synthetic peptide
  XENP020003 vhCDR2
FISYDGNNKYYADSVKG

SEQ ID NO: 2411 - protein, 9 aa, Artificial Sequence
  Description of Artificial Sequence: Synthetic peptide
  XENP020003 vhCDR3
TGWLGPFDY

SEQ ID NO: 2412 - protein, 12 aa, Artificial Sequence
  Description of Artificial Sequence: Synthetic peptide
  XENP020003 vlCDR1
RASQSVGSSYLA

SEQ ID NO: 2413 - protein, 7 aa, Artificial Sequence
  Description of Artificial Sequence: Synthetic peptide
  XENP020003 vlCDR2
GAFSRAT

SEQ ID NO: 2414 - protein, 9 aa, Artificial Sequence
  Description of Artificial Sequence: Synthetic peptide
  XENP020003 vlCDR3
QQYGSSPWV

SEQ ID NO: 2415 - protein, 246 aa, Artificial Sequence
  Description of Artificial Sequence: Synthetic polypeptide
  XENP020004 [CTLA-4]_H0_L0.112_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGGGTKVEIK

SEQ ID NO: 2416 - protein, 118 aa, Artificial Sequence; identical to SEQ ID NO: 22
  Description of Artificial Sequence: Synthetic polypeptide
  VH of XENP020004

SEQ ID NO: 2417 - protein, 108 aa, Artificial Sequence
  Description of Artificial Sequence: Synthetic polypeptide
  VL of XENP020004
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGGGTKVEIK

SEQ ID NO: 2418 - protein, 5 aa, Artificial Sequence
  Description of Artificial Sequence: Synthetic peptide
  XENP020004 vhCDR1
SYTMH

SEQ ID NO: 2419 - protein, 17 aa, Artificial Sequence
  Description of Artificial Sequence: Synthetic peptide
  XENP020004 vhCDR2
FISYDGNNKYYADSVKG

SEQ ID NO: 2420 - protein, 9 aa, Artificial Sequence
  Description of Artificial Sequence: Synthetic peptide
  XENP020004 vhCDR3
TGWLGPFDY

SEQ ID NO: 2421 - protein, 12 aa, Artificial Sequence
  Description of Artificial Sequence: Synthetic peptide
  XENP020004 vlCDR1
RASQSVGSSYLA

SEQ ID NO: 2422 - protein, 7 aa, Artificial Sequence
  Description of Artificial Sequence: Synthetic peptide
  XENP020004 vlCDR2
GAFSRAT

SEQ ID NO: 2423 - protein, 9 aa, Artificial Sequence
  Description of Artificial Sequence: Synthetic peptide
  XENP020004 vlCDR3
QQYGSSPWT

SEQ ID NO: 2424 - protein, 246 aa, Artificial Sequence
  Description of Artificial Sequence: Synthetic polypeptide
  XENP020005 [CTLA-4]_H0_L0.113_scFv(GKPGS)4
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGEGTKVEIK

SEQ ID NO: 2425 - protein, 118 aa, Artificial Sequence; identical to SEQ ID NO: 22
  Description of Artificial Sequence: Synthetic polypeptide
  VH of XENP020005

SEQ ID NO: 2426 - protein, 108 aa, Artificial Sequence; identical to SEQ ID NO: 59
  Description of Artificial Sequence: Synthetic polypeptide
  VL of XENP020005

SEQ ID NO: 2427 - protein, 5 aa, Artificial Sequence
  Description of Artificial Sequence: Synthetic peptide
  XENP020005 vhCDR1
SYTMH

SEQ ID NO: 2428 - protein, 17 aa, Artificial Sequence
  Description of Artificial Sequence: Synthetic peptide
  XENP020005 vhCDR2
FISYDGNNKYYADSVKG

SEQ ID NO: 2429 - protein, 9 aa, Artificial Sequence
  Description of Artificial Sequence: Synthetic peptide
  XENP020005 vhCDR3
TGWLGPFDY

SEQ ID NO: 2430 - protein, 12 aa, Artificial Sequence
  Description of Artificial Sequence: Synthetic peptide
  XENP020005 vlCDR1
RASQSVGSSYLA

SEQ ID NO: 2431 - protein, 7 aa, Artificial Sequence
  Description of Artificial Sequence: Synthetic peptide
  XENP020005 vlCDR2
GAFSRAT

SEQ ID NO: 2432 - protein, 9 aa, Artificial Sequence
  Description of Artificial Sequence: Synthetic peptide
  XENP020005 vlCDR3
QQYGSSPWT

SEQ ID NO: 2433 - protein, 246 aa, Artificial Sequence
  Description of Artificial Sequence: Synthetic polypeptide
  XENP020075 [CTLA-4]_H3.1_L0.12_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGLLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2434 - protein, 118 aa, Artificial Sequence
  Description of Artificial Sequence: Synthetic polypeptide
  VH of XENP020075
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGLLGPFDLWGQGTMVTVSS

SEQ ID NO: 2435 - protein, 108 aa, Artificial Sequence; identical to SEQ ID NO: 1517
  Description of Artificial Sequence: Synthetic polypeptide
  VL of XENP020075

SEQ ID NO: 2436 - protein, 5 aa, Artificial Sequence
  Description of Artificial Sequence: Synthetic peptide
  XENP020075 vhCDR1
SYTMH

SEQ ID NO: 2437 - protein, 17 aa, Artificial Sequence
  Description of Artificial Sequence: Synthetic peptide
  XENP020075 vhCDR2
FISYDGNHKYYADSVKG

SEQ ID NO: 2438 - protein, 9 aa, Artificial Sequence
  Description of Artificial Sequence: Synthetic peptide
  XENP020075 vhCDR3
TGLLGPFDL

SEQ ID NO: 2439 - protein, 12 aa, Artificial Sequence
  Description of Artificial Sequence: Synthetic peptide
  XENP020075 vlCDR1
RASQSVGSSYLA

SEQ ID NO: 2440 - protein, 7 aa, Artificial Sequence
  Description of Artificial Sequence: Synthetic peptide
  XENP020075 vlCDR2
GAFSRAT

SEQ ID NO: 2441 - protein, 9 aa, Artificial Sequence
  Description of Artificial Sequence: Synthetic peptide
  XENP020075 vlCDR3
QQYGSSPWT

SEQ ID NO: 2442 - protein, 246 aa, Artificial Sequence
  Description of Artificial Sequence: Synthetic polypeptide
  XENP020076 [CTLA-4]_H3.2_L0.12_scFv(GKPGS)4
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTGLLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2443 - protein, 118 aa, Artificial Sequence
  Description of Artificial Sequence: Synthetic polypeptide
  VH of XENP020076
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTGLLGPFDLWGQGTMVTVSS

SEQ ID NO: 2444 - protein, 108 aa, Artificial Sequence; identical to SEQ ID NO: 1517
  Description of Artificial Sequence: Synthetic polypeptide
  VL of XENP020076

SEQ ID NO: 2445 - protein, 5 aa, Artificial Sequence
  Description of Artificial Sequence: Synthetic peptide
  XENP020076 vhCDR1
SYTMH

SEQ ID NO: 2446 - protein, 17 aa, Artificial Sequence
  Description of Artificial Sequence: Synthetic peptide
  XENP020076 vhCDR2
FISYDGNTKYYADSVKG

SEQ ID NO: 2447 - protein, 9 aa, Artificial Sequence
  Description of Artificial Sequence: Synthetic peptide
  XENP020076 vhCDR3
TGLLGPFDL

SEQ ID NO: 2448 - protein, 12 aa, Artificial Sequence
  Description of Artificial Sequence: Synthetic peptide
  XENP020076 vlCDR1
RASQSVGSSYLA

SEQ ID NO: 2449 - protein, 7 aa, Artificial Sequence
  Description of Artificial Sequence: Synthetic peptide
  XENP020076 vlCDR2
GAFSRAT

SEQ ID NO: 2450 - protein, 9 aa, Artificial Sequence
  Description of Artificial Sequence: Synthetic peptide
  XENP020076 vlCDR3
QQYGSSPWT

SEQ ID NO: 2451 - protein, 246 aa, Artificial Sequence
  Description of Artificial Sequence: Synthetic polypeptide
  XENP020077 [CTLA-4]_H3.3_L0.12_scFv(GKPGS)4
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARTGLLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2452 - protein, 118 aa, Artificial Sequence
  Description of Artificial Sequence: Synthetic polypeptide
  VH of XENP020077
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARTGLLGPFDLWGQGTMVTVSS

SEQ ID NO: 2453 - protein, 108 aa, Artificial Sequence; identical to SEQ ID NO: 1517
  Description of Artificial Sequence: Synthetic polypeptide
  VL of XENP020077

SEQ ID NO: 2454 - protein, 5 aa, Artificial Sequence
  Description of Artificial Sequence: Synthetic peptide
  XENP020077 vhCDR1
SYTMH

SEQ ID NO: 2455 - protein, 17 aa, Artificial Sequence
  Description of Artificial Sequence: Synthetic peptide
  XENP020077 vhCDR2
FISYDGNQKYYADSVKG

SEQ ID NO: 2456 - protein, 9 aa, Artificial Sequence
  Description of Artificial Sequence: Synthetic peptide
  XENP020077 vhCDR3
TGLLGPFDL

SEQ ID NO: 2457 - protein, 12 aa, Artificial Sequence
  Description of Artificial Sequence: Synthetic peptide
  XENP020077 vlCDR1
RASQSVGSSYLA

SEQ ID NO: 2458 - protein, 7 aa, Artificial Sequence
  Description of Artificial Sequence: Synthetic peptide
  XENP020077 vlCDR2
GAFSRAT

SEQ ID NO: 2459 - protein, 9 aa, Artificial Sequence
  Description of Artificial Sequence: Synthetic peptide
  XENP020077 vlCDR3
QQYGSSPWT

SEQ ID NO: 2460 - protein, 246 aa, Artificial Sequence
  Description of Artificial Sequence: Synthetic polypeptide
  XENP020078 [CTLA-4]_H3.4_L0.12_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2461 - protein, 118 aa, Artificial Sequence
  Description of Artificial Sequence: Synthetic polypeptide
  VH of XENP020078
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSS

SEQ ID NO: 2462 - protein, 108 aa, Artificial Sequence; identical to SEQ ID NO: 1517
  Description of Artificial Sequence: Synthetic polypeptide
  VL of XENP020078

SEQ ID NO: 2463 - protein, 5 aa, Artificial Sequence
  Description of Artificial Sequence: Synthetic peptide
  XENP020078 vhCDR1
SYTMH

SEQ ID NO: 2464 - protein, 17 aa, Artificial Sequence
  Description of Artificial Sequence: Synthetic peptide
  XENP020078 vhCDR2
FISYDGNHKYYADSVKG

SEQ ID NO: 2465 - protein, 9 aa, Artificial Sequence
  Description of Artificial Sequence: Synthetic peptide
  XENP020078 vhCDR3
TGHLGPFDL

SEQ ID NO: 2466 - protein, 12 aa, Artificial Sequence
  Description of Artificial Sequence: Synthetic peptide
  XENP020078 vlCDR1
RASQSVGSSYLA

SEQ ID NO: 2467 - protein, 7 aa, Artificial Sequence
  Description of Artificial Sequence: Synthetic peptide
  XENP020078 vlCDR2
GAFSRAT

SEQ ID NO: 2468 - protein, 9 aa, Artificial Sequence
  Description of Artificial Sequence: Synthetic peptide
  XENP020078 vlCDR3
QQYGSSPWT

SEQ ID NO: 2469 - protein, 246 aa, Artificial Sequence
  Description of Artificial Sequence: Synthetic polypeptide
  XENP020079 [CTLA-4]_H3.5_L0.12_scFv(GKPGS)4
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTGHLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2470 - protein, 118 aa, Artificial Sequence
  Description of Artificial Sequence: Synthetic polypeptide
  VH of XENP020079
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTGHLGPFDLWGQGTMVTVSS

SEQ ID NO: 2471 - protein, 108 aa, Artificial Sequence; identical to SEQ ID NO: 1517
  Description of Artificial Sequence: Synthetic polypeptide
  VL of XENP020079

SEQ ID NO: 2472 - protein, 5 aa, Artificial Sequence
  Description of Artificial Sequence: Synthetic peptide
  XENP020079 vhCDR1
SYTMH

SEQ ID NO: 2473 - protein, 17 aa, Artificial Sequence
  Description of Artificial Sequence: Synthetic peptide
  XENP020079 vhCDR2
FISYDGNTKYYADSVKG

SEQ ID NO: 2474 - protein, 9 aa, Artificial Sequence
  Description of Artificial Sequence: Synthetic peptide
  XENP020079 vhCDR3
TGHLGPFDL

SEQ ID NO: 2475 - protein, 12 aa, Artificial Sequence
  Description of Artificial Sequence: Synthetic peptide
  XENP020079 vlCDR1
RASQSVGSSYLA

SEQ ID NO: 2476 - protein, 7 aa, Artificial Sequence
  Description of Artificial Sequence: Synthetic peptide
  XENP020079 vlCDR2
GAFSRAT

SEQ ID NO: 2477 - protein, 9 aa, Artificial Sequence
  Description of Artificial Sequence: Synthetic peptide
  XENP020079 vlCDR3
QQYGSSPWT

SEQ ID NO: 2478 - protein, 246 aa, Artificial Sequence
  Description of Artificial Sequence: Synthetic polypeptide
  XENP020080 [CTLA-4]_H3.6_L0.12_scFv(GKPGS)4
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARTGHLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2479 - protein, 118 aa, Artificial Sequence
  Description of Artificial Sequence: Synthetic polypeptide
  VH of XENP020080
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARTGHLGPFDLWGQGTMVTVSS

SEQ ID NO: 2480 - protein, 108 aa, Artificial Sequence; identical to SEQ ID NO: 1517
  Description of Artificial Sequence: Synthetic polypeptide
  VL of XENP020080

SEQ ID NO: 2481 - protein, 5 aa, Artificial Sequence
  Description of Artificial Sequence: Synthetic peptide
  XENP020080 vhCDR1
SYTMH

SEQ ID NO: 2482 - protein, 17 aa, Artificial Sequence
  Description of Artificial Sequence: Synthetic peptide
  XENP020080 vhCDR2
FISYDGNQKYYADSVKG

SEQ ID NO: 2483 - protein, 9 aa, Artificial Sequence
  Description of Artificial Sequence: Synthetic peptide
  XENP020080 vhCDR3
TGHLGPFDL

SEQ ID NO: 2484 - protein, 12 aa, Artificial Sequence
  Description of Artificial Sequence: Synthetic peptide
  XENP020080 vlCDR1
RASQSVGSSYLA

SEQ ID NO: 2485 - protein, 7 aa, Artificial Sequence
  Description of Artificial Sequence: Synthetic peptide
  XENP020080 vlCDR2
GAFSRAT

SEQ ID NO: 2486 - protein, 9 aa, Artificial Sequence
  Description of Artificial Sequence: Synthetic peptide
  XENP020080 vlCDR3
QQYGSSPWT

SEQ ID NO: 2487 - protein, 246 aa, Artificial Sequence
  Description of Artificial Sequence: Synthetic polypeptide
  XENP020081 [CTLA-4]_H3.7_L0.12_scFv(GKPGS)4
EVQLVESGGGLVKPGGSLRLSCAASGFTFSSYTMHWVRQAPGKGLEWVCFISYDGNNKYYADSVKGRFTCSRDNAKNSLYLQMNSLRAEDTAVYYCARTGWLGPFDYWGQGTLVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2488 - protein, 118 aa, Artificial Sequence
  Description of Artificial Sequence: Synthetic polypeptide
  VH of XENP020081
EVQLVESGGGLVKPGGSLRLSCAASGFTFSSYTMHWVRQAPGKGLEWVCFISYDGNNKYYADSVKGRFTCSRDNAKNSLYLQMNSLRAEDTAVYYCARTGWLGPFDYWGQGTLVTVSS

SEQ ID NO: 2489 - protein, 108 aa, Artificial Sequence; identical to SEQ ID NO: 1517
  Description of Artificial Sequence: Synthetic polypeptide
  VL of XENP020081

SEQ ID NO: 2490 - protein, 5 aa, Artificial Sequence
  Description of Artificial Sequence: Synthetic peptide
  XENP020081 vhCDR1
SYTMH

SEQ ID NO: 2491 - protein, 17 aa, Artificial Sequence
  Description of Artificial Sequence: Synthetic peptide
  XENP020081 vhCDR2
FISYDGNNKYYADSVKG

SEQ ID NO: 2492 - protein, 9 aa, Artificial Sequence
  Description of Artificial Sequence: Synthetic peptide
  XENP020081 vhCDR3
TGWLGPFDY

SEQ ID NO: 2493 - protein, 12 aa, Artificial Sequence
  Description of Artificial Sequence: Synthetic peptide
  XENP020081 vlCDR1
RASQSVGSSYLA

SEQ ID NO: 2494 - protein, 7 aa, Artificial Sequence
  Description of Artificial Sequence: Synthetic peptide
  XENP020081 vlCDR2
GAFSRAT

SEQ ID NO: 2495 - protein, 9 aa, Artificial Sequence
  Description of Artificial Sequence: Synthetic peptide
  XENP020081 vlCDR3
QQYGSSPWT

SEQ ID NO: 2496 - protein, 246 aa, Artificial Sequence
  Description of Artificial Sequence: Synthetic polypeptide
  XENP020082 [CTLA-4]_H3.8_L0.12_scFv(GKPGS)4
EVQLVESGGGLVKPGGSLRLSCAASGFTFSSYTMHWVRQAPGKCLEWVSFISYDGNNKYYADSVKGRFTISRDNAKNSLYLQMNSLRAEDTAVYYCARTGWLGPFDYWGQGTLVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2497 - protein, 118 aa, Artificial Sequence
  Description of Artificial Sequence: Synthetic polypeptide
  VH of XENP020082
EVQLVESGGGLVKPGGSLRLSCAASGFTFSSYTMHWVRQAPGKCLEWVSFISYDGNNKYYADSVKGRFTISRDNAKNSLYLQMNSLRAEDTAVYYCARTGWLGPFDYWGQGTLVTVSS

SEQ ID NO: 2498 - protein, 108 aa, Artificial Sequence; identical to SEQ ID NO: 1517
  Description of Artificial Sequence: Synthetic polypeptide
  VL of XENP020082

SEQ ID NO: 2499 - protein, 5 aa, Artificial Sequence
  Description of Artificial Sequence: Synthetic peptide
  XENP020082 vhCDR1
SYTMH

SEQ ID NO: 2500 - protein, 17 aa, Artificial Sequence
  Description of Artificial Sequence: Synthetic peptide
  XENP020082 vhCDR2
FISYDGNNKYYADSVKG

SEQ ID NO: 2501 - protein, 9 aa, Artificial Sequence
  Description of Artificial Sequence: Synthetic peptide
  XENP020082 vhCDR3
TGWLGPFDY

SEQ ID NO: 2502 - protein, 12 aa, Artificial Sequence
  Description of Artificial Sequence: Synthetic peptide
  XENP020082 vlCDR1
RASQSVGSSYLA

SEQ ID NO: 2503 - protein, 7 aa, Artificial Sequence
  Description of Artificial Sequence: Synthetic peptide
  XENP020082 vlCDR2
GAFSRAT

SEQ ID NO: 2504 - protein, 9 aa, Artificial Sequence
  Description of Artificial Sequence: Synthetic peptide
  XENP020082 vlCDR3
QQYGSSPWT

SEQ ID NO: 2505 - protein, 246 aa, Artificial Sequence
  Description of Artificial Sequence: Synthetic polypeptide
  XENP020360 [CTLA-4]_H3.9_L0.12_scFv(GKPGS)4
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARTGHLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2506 - protein, 118 aa, Artificial Sequence
  Description of Artificial Sequence: Synthetic polypeptide
  VH of XENP020360
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARTGHLGPFDLWGQGTMVTVSS

SEQ ID NO: 2507 - protein, 108 aa, Artificial Sequence; identical to SEQ ID NO: 1517
  Description of Artificial Sequence: Synthetic polypeptide
  VL of XENP020360

SEQ ID NO: 2508 - protein, 5 aa, Artificial Sequence
  Description of Artificial Sequence: Synthetic peptide
  XENP020360 vhCDR1
SYTMH

SEQ ID NO: 2509 - protein, 17 aa, Artificial Sequence
  Description of Artificial Sequence: Synthetic peptide
  XENP020360 vhCDR2
FISYDGNYKYYADSVKG

SEQ ID NO: 2510 - protein, 9 aa, Artificial Sequence
  Description of Artificial Sequence: Synthetic peptide
  XENP020360 vhCDR3
TGHLGPFDL

SEQ ID NO: 2511 - protein, 12 aa, Artificial Sequence
  Description of Artificial Sequence: Synthetic peptide
  XENP020360 vlCDR1
RASQSVGSSYLA

SEQ ID NO: 2512 - protein, 7 aa, Artificial Sequence
  Description of Artificial Sequence: Synthetic peptide
  XENP020360 vlCDR2
GAFSRAT

SEQ ID NO: 2513 - protein, 9 aa, Artificial Sequence
  Description of Artificial Sequence: Synthetic peptide
  XENP020360 vlCDR3
QQYGSSPWT

SEQ ID NO: 2514 - protein, 246 aa, Artificial Sequence
  Description of Artificial Sequence: Synthetic polypeptide
  XENP020361 [CTLA-4]_H3.10_L0.12_scFv(GKPGS)4
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARTGLLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2515 - protein, 118 aa, Artificial Sequence
  Description of Artificial Sequence: Synthetic polypeptide
  VH of XENP020361
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARTGLLGPFDLWGQGTMVTVSS

SEQ ID NO: 2516 - protein, 108 aa, Artificial Sequence; identical to SEQ ID NO: 1517
  Description of Artificial Sequence: Synthetic polypeptide
  VL of XENP020361

SEQ ID NO: 2517 - protein, 5 aa, Artificial Sequence
  Description of Artificial Sequence: Synthetic peptide
  XENP020361 vhCDR1
SYTMH

SEQ ID NO: 2518 - protein, 17 aa, Artificial Sequence
  Description of Artificial Sequence: Synthetic peptide
  XENP020361 vhCDR2
FISYDGNYKYYADSVKG

SEQ ID NO: 2519 - protein, 9 aa, Artificial Sequence
  Description of Artificial Sequence: Synthetic peptide
  XENP020361 vhCDR3
TGLLGPFDL

SEQ ID NO: 2520 - protein, 12 aa, Artificial Sequence
  Description of Artificial Sequence: Synthetic peptide
  XENP020361 vlCDR1
RASQSVGSSYLA

SEQ ID NO: 2521 - protein, 7 aa, Artificial Sequence
  Description of Artificial Sequence: Synthetic peptide
  XENP020361 vlCDR2
GAFSRAT

SEQ ID NO: 2522 - protein, 9 aa, Artificial Sequence
  Description of Artificial Sequence: Synthetic peptide
  XENP020361 vlCDR3
QQYGSSPWT

SEQ ID NO: 2523 - protein, 246 aa, Artificial Sequence
  Description of Artificial Sequence: Synthetic polypeptide
  XENP020362 [CTLA-4]_H3.11_L0.12_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARGGHLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2524 - protein, 118 aa, Artificial Sequence
  Description of Artificial Sequence: Synthetic polypeptide
  VH of XENP020362
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARGGHLGPFDLWGQGTMVTVSS

SEQ ID NO: 2525 - protein, 108 aa, Artificial Sequence; identical to SEQ ID NO: 1517
  Description of Artificial Sequence: Synthetic polypeptide
  VL of XENP020362

SEQ ID NO: 2526 - protein, 5 aa, Artificial Sequence
  Description of Artificial Sequence: Synthetic peptide
  XENP020362 vhCDR1
SYTMH

SEQ ID NO: 2527 - protein, 17 aa, Artificial Sequence
  Description of Artificial Sequence: Synthetic peptide
  XENP020362 vhCDR2
FISYDGNHKYYADSVKG

SEQ ID NO: 2528 - protein, 9 aa, Artificial Sequence
  Description of Artificial Sequence: Synthetic peptide
  XENP020362 vhCDR3
GGHLGPFDL

SEQ ID NO: 2529 - protein, 12 aa, Artificial Sequence
  Description of Artificial Sequence: Synthetic peptide
  XENP020362 vlCDR1
RASQSVGSSYLA

SEQ ID NO: 2530 - protein, 7 aa, Artificial Sequence
  Description of Artificial Sequence: Synthetic peptide
  XENP020362 vlCDR2
GAFSRAT

SEQ ID NO: 2531 - protein, 9 aa, Artificial Sequence
  Description of Artificial Sequence: Synthetic peptide
  XENP020362 vlCDR3
QQYGSSPWT

SEQ ID NO: 2532 - protein, 246 aa, Artificial Sequence
  Description of Artificial Sequence: Synthetic polypeptide
  XENP020363 [CTLA-4]_H3.12_L0.12_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTSHLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2533 - protein, 118 aa, Artificial Sequence
  Description of Artificial Sequence: Synthetic polypeptide
  VH of XENP020363
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTSHLGPFDLWGQGTMVTVSS

SEQ ID NO: 2534 - protein, 108 aa, Artificial Sequence; identical to SEQ ID NO: 1517
  Description of Artificial Sequence: Synthetic polypeptide
  VL of XENP020363

SEQ ID NO: 2535 - protein, 5 aa, Artificial Sequence
  Description of Artificial Sequence: Synthetic peptide
  XENP020363 vhCDR1
SYTMH

SEQ ID NO: 2536 - protein, 17 aa, Artificial Sequence
  Description of Artificial Sequence: Synthetic peptide
  XENP020363 vhCDR2
FISYDGNHKYYADSVKG

SEQ ID NO: 2537 - protein, 9 aa, Artificial Sequence
  Description of Artificial Sequence: Synthetic peptide
  XENP020363 vhCDR3
TSHLGPFDL

SEQ ID NO: 2538 - protein, 12 aa, Artificial Sequence
  Description of Artificial Sequence: Synthetic peptide
  XENP020363 vlCDR1
RASQSVGSSYLA

SEQ ID NO: 2539 - protein, 7 aa, Artificial Sequence
  Description of Artificial Sequence: Synthetic peptide
  XENP020363 vlCDR2
GAFSRAT

SEQ ID NO: 2540 - protein, 9 aa, Artificial Sequence
  Description of Artificial Sequence: Synthetic peptide
  XENP020363 vlCDR3
QQYGSSPWT

SEQ ID NO: 2541 - protein, 246 aa, Artificial Sequence
  Description of Artificial Sequence: Synthetic polypeptide
  XENP020364 [CTLA-4]_H3.13_L0.12_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARGGLLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2542 - protein, 118 aa, Artificial Sequence
  Description of Artificial Sequence: Synthetic polypeptide
  VH of XENP020364
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARGGLLGPFDLWGQGTMVTVSS

SEQ ID NO: 2543 - protein, 108 aa, Artificial Sequence; identical to SEQ ID NO: 1517
  Description of Artificial Sequence: Synthetic polypeptide
  VL of XENP020364

SEQ ID NO: 2544 - protein, 5 aa, Artificial Sequence
  Description of Artificial Sequence: Synthetic peptide
  XENP020364 vhCDR1
SYTMH

SEQ ID NO: 2545 - protein, 17 aa, Artificial Sequence
  Description of Artificial Sequence: Synthetic peptide
  XENP020364 vhCDR2
FISYDGNHKYYADSVKG

SEQ ID NO: 2546 - protein, 9 aa, Artificial Sequence
  Description of Artificial Sequence: Synthetic peptide
  XENP020364 vhCDR3
GGLLGPFDL

SEQ ID NO: 2547 - protein, 12 aa, Artificial Sequence
  Description of Artificial Sequence: Synthetic peptide
  XENP020364 vlCDR1
RASQSVGSSYLA

SEQ ID NO: 2548 - protein, 7 aa, Artificial Sequence
  Description of Artificial Sequence: Synthetic peptide
  XENP020364 vlCDR2
GAFSRAT

SEQ ID NO: 2549 - protein, 9 aa, Artificial Sequence
  Description of Artificial Sequence: Synthetic peptide
  XENP020364 vlCDR3
QQYGSSPWT

SEQ ID NO: 2550 - protein, 246 aa, Artificial Sequence
  Description of Artificial Sequence: Synthetic polypeptide
  XENP020365 [CTLA-4]_H3.14_L0.12_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTSLLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2551 - protein, 118 aa, Artificial Sequence
  Description of Artificial Sequence: Synthetic polypeptide
  VH of XENP020365
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTSLLGPFDLWGQGTMVTVSS

SEQ ID NO: 2552 - protein, 108 aa, Artificial Sequence; identical to SEQ ID NO: 1517
  Description of Artificial Sequence: Synthetic polypeptide
  VL of XENP020365

SEQ ID NO: 2553 - protein, 5 aa, Artificial Sequence
  Description of Artificial Sequence: Synthetic peptide
  XENP020365 vhCDR1
SYTMH

SEQ ID NO: 2554 - protein, 17 aa, Artificial Sequence
  Description of Artificial Sequence: Synthetic peptide
  XENP020365 vhCDR2
FISYDGNHKYYADSVKG

SEQ ID NO: 2555 - protein, 9 aa, Artificial Sequence
  Description of Artificial Sequence: Synthetic peptide
  XENP020365 vhCDR3
TSLLGPFDL

SEQ ID NO: 2556 - protein, 12 aa, Artificial Sequence
  Description of Artificial Sequence: Synthetic peptide
  XENP020365 vlCDR1
RASQSVGSSYLA

SEQ ID NO: 2557 - protein, 7 aa, Artificial Sequence
  Description of Artificial Sequence: Synthetic peptide
  XENP020365 vlCDR2
GAFSRAT

SEQ ID NO: 2558 - protein, 9 aa, Artificial Sequence
  Description of Artificial Sequence: Synthetic peptide
  XENP020365 vlCDR3
QQYGSSPWT

SEQ ID NO: 2559 - protein, 246 aa, Artificial Sequence
  Description of Artificial Sequence: Synthetic polypeptide
  XENP020366 [CTLA-4]_H3.15_L0.12_scFv(GKPGS)4
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARGGHLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2560 - protein, 118 aa, Artificial Sequence
  Description of Artificial Sequence: Synthetic polypeptide
  VH of XENP020366
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARGGHLGPFDLWGQGTMVTVSS

SEQ ID NO: 2561 - protein, 108 aa, Artificial Sequence; identical to SEQ ID NO: 1517
  Description of Artificial Sequence: Synthetic polypeptide
  VL of XENP020366

SEQ ID NO: 2562 - protein, 5 aa, Artificial Sequence
  Description of Artificial Sequence: Synthetic peptide
  XENP020366 vhCDR1
SYTMH

SEQ ID NO: 2563 - protein, 17 aa, Artificial Sequence
  Description of Artificial Sequence: Synthetic peptide
  XENP020366 vhCDR2
FISYDGNQKYYADSVKG

SEQ ID NO: 2564 - protein, 9 aa, Artificial Sequence
  Description of Artificial Sequence: Synthetic peptide
  XENP020366 vhCDR3
GGHLGPFDL

SEQ ID NO: 2565 - protein, 12 aa, Artificial Sequence
  Description of Artificial Sequence: Synthetic peptide
  XENP020366 vlCDR1
RASQSVGSSYLA

SEQ ID NO: 2566 - protein, 7 aa, Artificial Sequence
  Description of Artificial Sequence: Synthetic peptide
  XENP020366 vlCDR2
GAFSRAT

SEQ ID NO: 2567 - protein, 9 aa, Artificial Sequence
  Description of Artificial Sequence: Synthetic peptide
  XENP020366 vlCDR3
QQYGSSPWT

SEQ ID NO: 2568 - protein, 246 aa, Artificial Sequence
  Description of Artificial Sequence: Synthetic polypeptide
  XENP020367 [CTLA-4]_H3.16_L0.12_scFv(GKPGS)4
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARTSHLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2569 - protein, 118 aa, Artificial Sequence
  Description of Artificial Sequence: Synthetic polypeptide
  VH of XENP020367
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARTSHLGPFDLWGQGTMVTVSS

SEQ ID NO: 2570 - protein, 108 aa, Artificial Sequence; identical to SEQ ID NO: 1517
  Description of Artificial Sequence: Synthetic polypeptide
  VL of XENP020367

SEQ ID NO: 2571 - protein, 5 aa, Artificial Sequence
  Description of Artificial Sequence: Synthetic peptide
  XENP020367 vhCDR1
SYTMH

SEQ ID NO: 2572 - protein, 17 aa, Artificial Sequence
  Description of Artificial Sequence: Synthetic peptide
  XENP020367 vhCDR2
FISYDGNQKYYADSVKG

SEQ ID NO: 2573 - protein, 9 aa, Artificial Sequence
  Description of Artificial Sequence: Synthetic peptide
  XENP020367 vhCDR3
TSHLGPFDL

SEQ ID NO: 2574 - protein, 12 aa, Artificial Sequence
  Description of Artificial Sequence: Synthetic peptide
  XENP020367 vlCDR1
RASQSVGSSYLA

SEQ ID NO: 2575 - protein, 7 aa, Artificial Sequence
  Description of Artificial Sequence: Synthetic peptide
  XENP020367 vlCDR2
GAFSRAT

SEQ ID NO: 2576 - protein, 9 aa, Artificial Sequence
  Description of Artificial Sequence: Synthetic peptide
  XENP020367 vlCDR3
QQYGSSPWT

SEQ ID NO: 2577 - protein, 246 aa, Artificial Sequence
  Description of Artificial Sequence: Synthetic polypeptide
  XENP020368 [CTLA-4]_H3.17_L0.12_scFv(GKPGS)4
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARGGLLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2578 - protein, 118 aa, Artificial Sequence
  Description of Artificial Sequence: Synthetic polypeptide
  VH of XENP020368
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARGGLLGPFDLWGQGTMVTVSS

SEQ ID NO: 2579 - protein, 108 aa, Artificial Sequence; identical to SEQ ID NO: 1517
  Description of Artificial Sequence: Synthetic polypeptide
  VL of XENP020368

SEQ ID NO: 2580 - protein, 5 aa, Artificial Sequence
  Description of Artificial Sequence: Synthetic peptide
  XENP020368 vhCDR1
SYTMH

SEQ ID NO: 2581 - protein, 17 aa, Artificial Sequence
  Description of Artificial Sequence: Synthetic peptide
  XENP020368 vhCDR2
FISYDGNQKYYADSVKG

SEQ ID NO: 2582 - protein, 9 aa, Artificial Sequence
  Description of Artificial Sequence: Synthetic peptide
  XENP020368 vhCDR3
GGLLGPFDL

SEQ ID NO: 2583 - protein, 12 aa, Artificial Sequence
  Description of Artificial Sequence: Synthetic peptide
  XENP020368 vlCDR1
RASQSVGSSYLA

SEQ ID NO: 2584 - protein, 7 aa, Artificial Sequence
  Description of Artificial Sequence: Synthetic peptide
  XENP020368 vlCDR2
GAFSRAT

SEQ ID NO: 2585 - protein, 9 aa, Artificial Sequence
  Description of Artificial Sequence: Synthetic peptide
  XENP020368 vlCDR3
QQYGSSPWT

SEQ ID NO: 2586 - protein, 246 aa, Artificial Sequence
  Description of Artificial Sequence: Synthetic polypeptide
  XENP020369 [CTLA-4]_H3.18_L0.12_scFv(GKPGS)4
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARTSLLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2587 - protein, 118 aa, Artificial Sequence
  Description of Artificial Sequence: Synthetic polypeptide
  VH of XENP020369
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARTSLLGPFDLWGQGTMVTVSS

SEQ ID NO: 2588 - protein, 108 aa, Artificial Sequence; identical to SEQ ID NO: 1517
  Description of Artificial Sequence: Synthetic polypeptide
  VL of XENP020369

SEQ ID NO: 2589 - protein, 5 aa, Artificial Sequence
  Description of Artificial Sequence: Synthetic peptide
  XENP020369 vhCDR1
SYTMH

SEQ ID NO: 2590 - protein, 17 aa, Artificial Sequence
  Description of Artificial Sequence: Synthetic peptide
  XENP020369 vhCDR2
FISYDGNQKYYADSVKG

SEQ ID NO: 2591 - protein, 9 aa, Artificial Sequence
  Description of Artificial Sequence: Synthetic peptide
  XENP020369 vhCDR3
TSLLGPFDL

SEQ ID NO: 2592 - protein, 12 aa, Artificial Sequence
  Description of Artificial Sequence: Synthetic peptide
  XENP020369 vlCDR1
RASQSVGSSYLA

SEQ ID NO: 2593 - protein, 7 aa, Artificial Sequence
  Description of Artificial Sequence: Synthetic peptide
  XENP020369 vlCDR2
GAFSRAT

SEQ ID NO: 2594 - protein, 9 aa, Artificial Sequence
  Description of Artificial Sequence: Synthetic peptide
  XENP020369 vlCDR3
QQYGSSPWT

SEQ ID NO: 2595 - protein, 246 aa, Artificial Sequence
  Description of Artificial Sequence: Synthetic polypeptide
  XENP020370 [CTLA-4]_H3.19_L0.12_scFv(GKPGS)4
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARGGHLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2596 - protein, 118 aa, Artificial Sequence
  Description of Artificial Sequence: Synthetic polypeptide
  VH of XENP020370
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARGGHLGPFDLWGQGTMVTVSS

SEQ ID NO: 2597 - protein, 108 aa, Artificial Sequence; identical to SEQ ID NO: 1517
  Description of Artificial Sequence: Synthetic polypeptide
  VL of XENP020370

SEQ ID NO: 2598 - protein, 5 aa, Artificial Sequence
  Description of Artificial Sequence: Synthetic peptide
  XENP020370 vhCDR1
SYTMH

SEQ ID NO: 2599 - protein, 17 aa, Artificial Sequence
  Description of Artificial Sequence: Synthetic peptide
  XENP020370 vhCDR2
FISYDGNTKYYADSVKG

SEQ ID NO: 2600 - protein, 9 aa, Artificial Sequence
  Description of Artificial Sequence: Synthetic peptide
  XENP020370 vhCDR3
GGHLGPFDL

SEQ ID NO: 2601 - protein, 12 aa, Artificial Sequence
  Description of Artificial Sequence: Synthetic peptide
  XENP020370 vlCDR1
RASQSVGSSYLA

SEQ ID NO: 2602 - protein, 7 aa, Artificial Sequence
  Description of Artificial Sequence: Synthetic peptide
  XENP020370 vlCDR2
GAFSRAT

SEQ ID NO: 2603 - protein, 9 aa, Artificial Sequence
  Description of Artificial Sequence: Synthetic peptide
  XENP020370 vlCDR3
QQYGSSPWT

SEQ ID NO: 2604 - protein, 246 aa, Artificial Sequence
  Description of Artificial Sequence: Synthetic polypeptide
  XENP020371 [CTLA-4]_H3.20_L0.12_scFv(GKPGS)4
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTSHLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2605 - protein, 118 aa, Artificial Sequence
  Description of Artificial Sequence: Synthetic polypeptide
  VH of XENP020371
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTSHLGPFDLWGQGTMVTVSS

SEQ ID NO: 2606 - protein, 108 aa, Artificial Sequence; identical to SEQ ID NO: 1517
  Description of Artificial Sequence: Synthetic polypeptide
  VL of XENP020371

SEQ ID NO: 2607 - protein, 5 aa, Artificial Sequence
  Description of Artificial Sequence: Synthetic peptide
  XENP020371 vhCDR1
SYTMH

SEQ ID NO: 2608 - protein, 17 aa, Artificial Sequence
  Description of Artificial Sequence: Synthetic peptide
  XENP020371 vhCDR2
FISYDGNTKYYADSVKG

SEQ ID NO: 2609 - protein, 9 aa, Artificial Sequence
  Description of Artificial Sequence: Synthetic peptide
  XENP020371 vhCDR3
TSHLGPFDL

SEQ ID NO: 2610 - protein, 12 aa, Artificial Sequence
  Description of Artificial Sequence: Synthetic peptide
  XENP020371 vlCDR1
RASQSVGSSYLA

SEQ ID NO: 2611 - protein, 7 aa, Artificial Sequence
  Description of Artificial Sequence: Synthetic peptide
  XENP020371 vlCDR2
GAFSRAT

SEQ ID NO: 2612 - protein, 9 aa, Artificial Sequence
  Description of Artificial Sequence: Synthetic peptide
  XENP020371 vlCDR3
QQYGSSPWT

SEQ ID NO: 2613 - protein, 246 aa, Artificial Sequence
  Description of Artificial Sequence: Synthetic polypeptide
  XENP020372 [CTLA-4]_H3.21_L0.12_scFv(GKPGS)4
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARGGLLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2614 - protein, 118 aa, Artificial Sequence
  Description of Artificial Sequence: Synthetic polypeptide
  VH of XENP020372
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARGGLLGPFDLWGQGTMVTVSS

SEQ ID NO: 2615 - protein, 108 aa, Artificial Sequence; identical to SEQ ID NO: 1517
  Description of Artificial Sequence: Synthetic polypeptide
  VL of XENP020372

SEQ ID NO: 2616 - protein, 5 aa, Artificial Sequence
  Description of Artificial Sequence: Synthetic peptide
  XENP020372 vhCDR1
SYTMH

SEQ ID NO: 2617 - protein, 17 aa, Artificial Sequence
  Description of Artificial Sequence: Synthetic peptide
  XENP020372 vhCDR2
FISYDGNTKYYADSVKG

SEQ ID NO: 2618 - protein, 9 aa, Artificial Sequence
  Description of Artificial Sequence: Synthetic peptide
  XENP020372 vhCDR3
GGLLGPFDL

SEQ ID NO: 2619 - protein, 12 aa, Artificial Sequence
  Description of Artificial Sequence: Synthetic peptide
  XENP020372 vlCDR1
RASQSVGSSYLA

SEQ ID NO: 2620 - protein, 7 aa, Artificial Sequence
  Description of Artificial Sequence: Synthetic peptide
  XENP020372 vlCDR2
GAFSRAT

SEQ ID NO: 2621 - protein, 9 aa, Artificial Sequence
  Description of Artificial Sequence: Synthetic peptide
  XENP020372 vlCDR3
QQYGSSPWT

SEQ ID NO: 2622 - protein, 246 aa, Artificial Sequence
  Description of Artificial Sequence: Synthetic polypeptide
  XENP020373 [CTLA-4]_H3.22_L0.12_scFv(GKPGS)4
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTSLLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2623 - protein, 118 aa, Artificial Sequence
  Description of Artificial Sequence: Synthetic polypeptide
  VH of XENP020373
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTSLLGPFDLWGQGTMVTVSS

SEQ ID NO: 2624 - protein, 108 aa, Artificial Sequence; identical to SEQ ID NO: 1517
  Description of Artificial Sequence: Synthetic polypeptide
  VL of XENP020373

SEQ ID NO: 2625 - protein, 5 aa, Artificial Sequence
  Description of Artificial Sequence: Synthetic peptide
  XENP020373 vhCDR1
SYTMH

SEQ ID NO: 2626 - protein, 17 aa, Artificial Sequence
  Description of Artificial Sequence: Synthetic peptide
  XENP020373 vhCDR2
FISYDGNTKYYADSVKG

SEQ ID NO: 2627 - protein, 9 aa, Artificial Sequence
  Description of Artificial Sequence: Synthetic peptide
  XENP020373 vhCDR3
TSLLGPFDL

SEQ ID NO: 2628 - protein, 12 aa, Artificial Sequence
  Description of Artificial Sequence: Synthetic peptide
  XENP020373 vlCDR1
RASQSVGSSYLA

SEQ ID NO: 2629 - protein, 7 aa, Artificial Sequence
  Description of Artificial Sequence: Synthetic peptide
  XENP020373 vlCDR2
GAFSRAT

SEQ ID NO: 2630 - protein, 9 aa, Artificial Sequence
  Description of Artificial Sequence: Synthetic peptide
  XENP020373 vlCDR3
QQYGSSPWT

SEQ ID NO: 2631 - protein, 246 aa, Artificial Sequence
  Description of Artificial Sequence: Synthetic polypeptide
  XENP020374 [CTLA-4]_H3.23_L0.12_scFv(GKPGS)4
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGHLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2632 - protein, 118 aa, Artificial Sequence
  Description of Artificial Sequence: Synthetic polypeptide
  VH of XENP020374
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGHLGPFDLWGQGTMVTVSS

SEQ ID NO: 2633 - protein, 108 aa, Artificial Sequence; identical to SEQ ID NO: 1517
  Description of Artificial Sequence: Synthetic polypeptide
  VL of XENP020374

SEQ ID NO: 2634 - protein, 5 aa, Artificial Sequence
  Description of Artificial Sequence: Synthetic peptide
  XENP020374 vhCDR1
SYTMH

SEQ ID NO: 2635 - protein, 17 aa, Artificial Sequence
  Description of Artificial Sequence: Synthetic peptide
  XENP020374 vhCDR2
FISYDGNYKYYADSVKG

SEQ ID NO: 2636 - protein, 9 aa, Artificial Sequence
  Description of Artificial Sequence: Synthetic peptide
  XENP020374 vhCDR3
GGHLGPFDL

SEQ ID NO: 2637 - protein, 12 aa, Artificial Sequence
  Description of Artificial Sequence: Synthetic peptide
  XENP020374 vlCDR1
RASQSVGSSYLA

SEQ ID NO: 2638 - protein, 7 aa, Artificial Sequence
  Description of Artificial Sequence: Synthetic peptide
  XENP020374 vlCDR2
GAFSRAT

SEQ ID NO: 2639 - protein, 9 aa, Artificial Sequence
  Description of Artificial Sequence: Synthetic peptide
  XENP020374 vlCDR3
QQYGSSPWT

SEQ ID NO: 2640 - protein, 246 aa, Artificial Sequence
  Description of Artificial Sequence: Synthetic polypeptide
  XENP020375 [CTLA-4]_H3.24_L0.12_scFv(GKPGS)4
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARTSHLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2641 - protein, 118 aa, Artificial Sequence
  Description of Artificial Sequence: Synthetic polypeptide
  VH of XENP020375
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARTSHLGPFDLWGQGTMVTVSS

SEQ ID NO: 2642 - protein, 108 aa, Artificial Sequence; identical to SEQ ID NO: 1517
  Description of Artificial Sequence: Synthetic polypeptide
  VL of XENP020375

SEQ ID NO: 2643 - protein, 5 aa, Artificial Sequence
  Description of Artificial Sequence: Synthetic peptide
  XENP020375 vhCDR1
SYTMH

SEQ ID NO: 2644 - protein, 17 aa, Artificial Sequence
  Description of Artificial Sequence: Synthetic peptide
  XENP020375 vhCDR2
FISYDGNYKYYADSVKG

SEQ ID NO: 2645 - protein, 9 aa, Artificial Sequence
  Description of Artificial Sequence: Synthetic peptide
  XENP020375 vhCDR3
TSHLGPFDL

SEQ ID NO: 2646 - protein, 12 aa, Artificial Sequence
  Description of Artificial Sequence: Synthetic peptide
  XENP020375 vlCDR1
RASQSVGSSYLA

SEQ ID NO: 2647 - protein, 7 aa, Artificial Sequence
  Description of Artificial Sequence: Synthetic peptide
  XENP020375 vlCDR2
GAFSRAT

SEQ ID NO: 2648 - protein, 9 aa, Artificial Sequence
  Description of Artificial Sequence: Synthetic peptide
  XENP020375 vlCDR3
QQYGSSPWT

SEQ ID NO: 2649 - protein, 246 aa, Artificial Sequence
  Description of Artificial Sequence: Synthetic polypeptide
  XENP020376 [CTLA-4]_H3.25_L0.12_scFv(GKPGS)4
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGLLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2650 - protein, 118 aa, Artificial Sequence
  Description of Artificial Sequence: Synthetic polypeptide
  VH of XENP020376
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGLLGPFDLWGQGTMVTVSS

SEQ ID NO: 2651 - protein, 108 aa, Artificial Sequence; identical to SEQ ID NO: 1517
  Description of Artificial Sequence: Synthetic polypeptide
  VL of XENP020376

SEQ ID NO: 2652 - protein, 5 aa, Artificial Sequence
  Description of Artificial Sequence: Synthetic peptide
  XENP020376 vhCDR1
SYTMH

SEQ ID NO: 2653 - protein, 17 aa, Artificial Sequence
  Description of Artificial Sequence: Synthetic peptide
  XENP020376 vhCDR2
FISYDGNYKYYADSVKG

SEQ ID NO: 2654 - protein, 9 aa, Artificial Sequence
  Description of Artificial Sequence: Synthetic peptide
  XENP020376 vhCDR3
GGLLGPFDL

SEQ ID NO: 2655 - protein, 12 aa, Artificial Sequence
  Description of Artificial Sequence: Synthetic peptide
  XENP020376 vlCDR1
RASQSVGSSYLA

SEQ ID NO: 2656 - protein, 7 aa, Artificial Sequence
  Description of Artificial Sequence: Synthetic peptide
  XENP020376 vlCDR2
GAFSRAT

SEQ ID NO: 2657 - protein, 9 aa, Artificial Sequence
  Description of Artificial Sequence: Synthetic peptide
  XENP020376 vlCDR3
QQYGSSPWT

SEQ ID NO: 2658 - protein, 246 aa, Artificial Sequence
  Description of Artificial Sequence: Synthetic polypeptide
  XENP020377 [CTLA-4]_H3.26_L0.12_scFv(GKPGS)4
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARTSLLGPFDLWGQGTMVTVSSGKPGSGKPGSGKPGSGKPGSEIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2659 - protein, 118 aa, Artificial Sequence
  Description of Artificial Sequence: Synthetic polypeptide
  VH of XENP020377
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARTSLLGPFDLWGQGTMVTVSS

SEQ ID NO: 2660 - protein, 108 aa, Artificial Sequence; identical to SEQ ID NO: 1517
  Description of Artificial Sequence: Synthetic polypeptide
  VL of XENP020377

SEQ ID NO: 2661 - protein, 5 aa, Artificial Sequence
  Description of Artificial Sequence: Synthetic peptide
  XENP020377 vhCDR1
SYTMH

SEQ ID NO: 2662 - protein, 17 aa, Artificial Sequence
  Description of Artificial Sequence: Synthetic peptide
  XENP020377 vhCDR2
FISYDGNYKYYADSVKG

SEQ ID NO: 2663 - protein, 9 aa, Artificial Sequence
  Description of Artificial Sequence: Synthetic peptide
  XENP020377 vhCDR3
TSLLGPFDL

SEQ ID NO: 2664 - protein, 12 aa, Artificial Sequence
  Description of Artificial Sequence: Synthetic peptide
  XENP020377 vlCDR1
RASQSVGSSYLA

SEQ ID NO: 2665 - protein, 7 aa, Artificial Sequence
  Description of Artificial Sequence: Synthetic peptide
  XENP020377 vlCDR2
GAFSRAT

SEQ ID NO: 2666 - protein, 9 aa, Artificial Sequence
  Description of Artificial Sequence: Synthetic peptide
  XENP020377 vlCDR3
QQYGSSPWT

SEQ ID NO: 2667 - protein, 246 aa, Artificial Sequence
  Description of Artificial Sequence: Synthetic polypeptide
  XENP020378 [CTLA-4]_H3.4_L0.118_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSGKPGSGKPGSGKPGSGKPGSEIVLTQSPATLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2668 - protein, 118 aa, Artificial Sequence; identical to SEQ ID NO: 2461
  Description of Artificial Sequence: Synthetic polypeptide
  VH of XENP020378

SEQ ID NO: 2669 - protein, 108 aa, Artificial Sequence
  Description of Artificial Sequence: Synthetic polypeptide
  VL of XENP020378
EIVLTQSPATLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2670 - protein, 5 aa, Artificial Sequence
  Description of Artificial Sequence: Synthetic peptide
  XENP020378 vhCDR1
SYTMH

SEQ ID NO: 2671 - protein, 17 aa, Artificial Sequence
  Description of Artificial Sequence: Synthetic peptide
  XENP020378 vhCDR2
FISYDGNHKYYADSVKG

SEQ ID NO: 2672 - protein, 9 aa, Artificial Sequence
  Description of Artificial Sequence: Synthetic peptide
  XENP020378 vhCDR3
TGHLGPFDL

SEQ ID NO: 2673 - protein, 12 aa, Artificial Sequence
  Description of Artificial Sequence: Synthetic peptide
  XENP020378 vlCDR1
RASQSVGSSYLA

SEQ ID NO: 2674 - protein, 7 aa, Artificial Sequence
  Description of Artificial Sequence: Synthetic peptide
  XENP020378 vlCDR2
GAFSRAT

SEQ ID NO: 2675 - protein, 9 aa, Artificial Sequence
  Description of Artificial Sequence: Synthetic peptide
  XENP020378 vlCDR3
QQYGSSPWT

SEQ ID NO: 2676 - protein, 246 aa, Artificial Sequence
  Description of Artificial Sequence: Synthetic polypeptide
  XENP020379 [CTLA-4]_H3.4_L0.119_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSGKPGSGKPGSGKPGSGKPGSEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2677 - protein, 118 aa, Artificial Sequence; identical to SEQ ID NO: 2461
  Description of Artificial Sequence: Synthetic polypeptide
  VH of XENP020379

SEQ ID NO: 2678 - protein, 108 aa, Artificial Sequence; identical to SEQ ID NO: 23
  Description of Artificial Sequence: Synthetic polypeptide
  VL of XENP020379

SEQ ID NO: 2679 - protein, 5 aa, Artificial Sequence
  Description of Artificial Sequence: Synthetic peptide
  XENP020379 vhCDR1
SYTMH

SEQ ID NO: 2680 - protein, 17 aa, Artificial Sequence
  Description of Artificial Sequence: Synthetic peptide
  XENP020379 vhCDR2
FISYDGNHKYYADSVKG

SEQ ID NO: 2681 - protein, 9 aa, Artificial Sequence
  Description of Artificial Sequence: Synthetic peptide
  XENP020379 vhCDR3
TGHLGPFDL

SEQ ID NO: 2682 - protein, 12 aa, Artificial Sequence
  Description of Artificial Sequence: Synthetic peptide
  XENP020379 vlCDR1
RASQSVGSSYLA

SEQ ID NO: 2683 - protein, 7 aa, Artificial Sequence
  Description of Artificial Sequence: Synthetic peptide
  XENP020379 vlCDR2
GAFSRAT

SEQ ID NO: 2684 - protein, 9 aa, Artificial Sequence
  Description of Artificial Sequence: Synthetic peptide
  XENP020379 vlCDR3
QQYGSSPWT

SEQ ID NO: 2685 - protein, 246 aa, Artificial Sequence
  Description of Artificial Sequence: Synthetic polypeptide
  XENP020380 [CTLA-4]_H3.4_L0.120_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSGKPGSGKPGSGKPGSGKPGSEIVLTQSPGTLSVSPGERATLSCRASQSVSSSYLAWYQQKPGQAPRLLIYGAFSRATGIPDRFSGSGSGTDFTLTISRLEPEDFAVYYCQQYGSSPWTFGQGTKVEIK

SEQ ID NO: 2686 - protein, 118 aa, Artificial Sequence; identical to SEQ ID NO: 2461
  Description of Artificial Sequence: Synthetic polypeptide
  VH of XENP020380

SEQ ID NO: 2687 - protein, 108 aa, Artificial Sequence
  Description of Artificial Sequence: Synthetic polypeptide
  VL of XENP020380
EIVLTQSPGTLSVSPGERATLSCRASQSVSSSYLAWYQQKPGQAPRLLIYGAFSRATGIPDRFSGSGSGTDFTLTISRLEPEDFAVYYCQQYGSSPWTFGQGTKVEIK

SEQ ID NO: 2688 - protein, 5 aa, Artificial Sequence
  Description of Artificial Sequence: Synthetic peptide
  XENP020380 vhCDR1
SYTMH

SEQ ID NO: 2689 - protein, 17 aa, Artificial Sequence
  Description of Artificial Sequence: Synthetic peptide
  XENP020380 vhCDR2
FISYDGNHKYYADSVKG

SEQ ID NO: 2690 - protein, 9 aa, Artificial Sequence
  Description of Artificial Sequence: Synthetic peptide
  XENP020380 vhCDR3
TGHLGPFDL

SEQ ID NO: 2691 - protein, 12 aa, Artificial Sequence
  Description of Artificial Sequence: Synthetic peptide
  XENP020380 vlCDR1
RASQSVSSSYLA

SEQ ID NO: 2692 - protein, 7 aa, Artificial Sequence
  Description of Artificial Sequence: Synthetic peptide
  XENP020380 vlCDR2
GAFSRAT

SEQ ID NO: 2693 - protein, 9 aa, Artificial Sequence
  Description of Artificial Sequence: Synthetic peptide
  XENP020380 vlCDR3
QQYGSSPWT

SEQ ID NO: 2694 - protein, 246 aa, Artificial Sequence
  Description of Artificial Sequence: Synthetic polypeptide
  XENP020381 [CTLA-4]_H3.4_L0.121_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSGKPGSGKPGSGKPGSGKPGSEIVLTQSPGTLSVSPGERATLSCRASQSVGSSYLAWYQQKPGQAPRLLIYGASSRATGIPDRFSGSGSGTDFTLTISRLEPEDFAVYYCQQYGSSPWTFGQGTKVEIK

SEQ ID NO: 2695 - protein, 118 aa, Artificial Sequence; identical to SEQ ID NO: 2461
  Description of Artificial Sequence: Synthetic polypeptide
  VH of XENP020381

SEQ ID NO: 2696 - protein, 108 aa, Artificial Sequence
  Description of Artificial Sequence: Synthetic polypeptide
  VL of XENP020381
EIVLTQSPGTLSVSPGERATLSCRASQSVGSSYLAWYQQKPGQAPRLLIYGASSRATGIPDRFSGSGSGTDFTLTISRLEPEDFAVYYCQQYGSSPWTFGQGTKVEIK

SEQ ID NO: 2697 - protein, 5 aa, Artificial Sequence
  Description of Artificial Sequence: Synthetic peptide
  XENP020381 vhCDR1
SYTMH

SEQ ID NO: 2698 - protein, 17 aa, Artificial Sequence
  Description of Artificial Sequence: Synthetic peptide
  XENP020381 vhCDR2
FISYDGNHKYYADSVKG

SEQ ID NO: 2699 - protein, 9 aa, Artificial Sequence
  Description of Artificial Sequence: Synthetic peptide
  XENP020381 vhCDR3
TGHLGPFDL

SEQ ID NO: 2700 - protein, 12 aa, Artificial Sequence
  Description of Artificial Sequence: Synthetic peptide
  XENP020381 vlCDR1
RASQSVGSSYLA

SEQ ID NO: 2701 - protein, 7 aa, Artificial Sequence
  Description of Artificial Sequence: Synthetic peptide
  XENP020381 vlCDR2
GASSRAT

SEQ ID NO: 2702 - protein, 9 aa, Artificial Sequence
  Description of Artificial Sequence: Synthetic peptide
  XENP020381 vlCDR3
QQYGSSPWT

SEQ ID NO: 2703 - protein, 246 aa, Artificial Sequence
  Description of Artificial Sequence: Synthetic polypeptide
  XENP020382 [CTLA-4]_H3.4_L0.122_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSGKPGSGKPGSGKPGSGKPGSEIVLTQSPATLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 2704 - protein, 118 aa, Artificial Sequence; identical to SEQ ID NO: 2461
  Description of Artificial Sequence: Synthetic polypeptide
  VH of XENP020382

SEQ ID NO: 2705 - protein, 108 aa, Artificial Sequence; identical to SEQ ID NO: 1481
  Description of Artificial Sequence: Synthetic polypeptide
  VL of XENP020382

SEQ ID NO: 2706 - protein, 5 aa, Artificial Sequence
  Description of Artificial Sequence: Synthetic peptide
  XENP020382 vhCDR1
SYTMH

SEQ ID NO: 2707 - protein, 17 aa, Artificial Sequence
  Description of Artificial Sequence: Synthetic peptide
  XENP020382 vhCDR2
FISYDGNHKYYADSVKG

SEQ ID NO: 2708 - protein, 9 aa, Artificial Sequence
  Description of Artificial Sequence: Synthetic peptide
  XENP020382 vhCDR3
TGHLGPFDL

SEQ ID NO: 2709 - protein, 12 aa, Artificial Sequence
  Description of Artificial Sequence: Synthetic peptide
  XENP020382 vlCDR1
RASQSVGSSYLA

SEQ ID NO: 2710 - protein, 7 aa, Artificial Sequence
  Description of Artificial Sequence: Synthetic peptide
  XENP020382 vlCDR2
GAFSRAT

SEQ ID NO: 2711 - protein, 9 aa, Artificial Sequence
  Description of Artificial Sequence: Synthetic peptide
  XENP020382 vlCDR3
QQYGSSPWT

SEQ ID NO: 2712 - protein, 246 aa, Artificial Sequence
  Description of Artificial Sequence: Synthetic polypeptide
  XENP020383 [CTLA-4]_H3.4_L0.123_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSGKPGSGKPGSGKPGSGKPGSEIVLTQSPATLSVSPGERATLSCRASQSVSSSYLAWYQQKPGQAPRLLIYGAFSRATGIPDRFSGSGSGTDFTLTISRLEPEDFAVYYCQQYGSSPWTFGQGTKVEIK

SEQ ID NO: 2713 - protein, 118 aa, Artificial Sequence; identical to SEQ ID NO: 2461
  Description of Artificial Sequence: Synthetic polypeptide
  VH of XENP020383

SEQ ID NO: 2714 - protein, 108 aa, Artificial Sequence
  Description of Artificial Sequence: Synthetic polypeptide
  VL of XENP020383
EIVLTQSPATLSVSPGERATLSCRASQSVSSSYLAWYQQKPGQAPRLLIYGAFSRATGIPDRFSGSGSGTDFTLTISRLEPEDFAVYYCQQYGSSPWTFGQGTKVEIK

SEQ ID NO: 2715 - protein, 5 aa, Artificial Sequence
  Description of Artificial Sequence: Synthetic peptide
  XENP020383 vhCDR1
SYTMH

SEQ ID NO: 2716 - protein, 17 aa, Artificial Sequence
  Description of Artificial Sequence: Synthetic peptide
  XENP020383 vhCDR2
FISYDGNHKYYADSVKG

SEQ ID NO: 2717 - protein, 9 aa, Artificial Sequence
  Description of Artificial Sequence: Synthetic peptide
  XENP020383 vhCDR3
TGHLGPFDL

SEQ ID NO: 2718 - protein, 12 aa, Artificial Sequence
  Description of Artificial Sequence: Synthetic peptide
  XENP020383 vlCDR1
RASQSVSSSYLA

SEQ ID NO: 2719 - protein, 7 aa, Artificial Sequence
  Description of Artificial Sequence: Synthetic peptide
  XENP020383 vlCDR2
GAFSRAT

SEQ ID NO: 2720 - protein, 9 aa, Artificial Sequence
  Description of Artificial Sequence: Synthetic peptide
  XENP020383 vlCDR3
QQYGSSPWT

SEQ ID NO: 2721 - protein, 246 aa, Artificial Sequence
  Description of Artificial Sequence: Synthetic polypeptide
  XENP020384 [CTLA-4]_H3.4_L0.124_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSGKPGSGKPGSGKPGSGKPGSEIVLTQSPATLSVSPGERATLSCRASQSVGSSYLAWYQQKPGQAPRLLIYGASSRATGIPDRFSGSGSGTDFTLTISRLEPEDFAVYYCQQYGSSPWTFGQGTKVEIK

SEQ ID NO: 2722 - protein, 118 aa, Artificial Sequence; identical to SEQ ID NO: 2461
  Description of Artificial Sequence: Synthetic polypeptide
  VH of XENP020384

SEQ ID NO: 2723 - protein, 108 aa, Artificial Sequence
  Description of Artificial Sequence: Synthetic polypeptide
  VL of XENP020384
EIVLTQSPATLSVSPGERATLSCRASQSVGSSYLAWYQQKPGQAPRLLIYGASSRATGIPDRFSGSGSGTDFTLTISRLEPEDFAVYYCQQYGSSPWTFGQGTKVEIK

SEQ ID NO: 2724 - protein, 5 aa, Artificial Sequence
  Description of Artificial Sequence: Synthetic peptide
  XENP020384 vhCDR1
SYTMH

SEQ ID NO: 2725 - protein, 17 aa, Artificial Sequence
  Description of Artificial Sequence: Synthetic peptide
  XENP020384 vhCDR2
FISYDGNHKYYADSVKG

SEQ ID NO: 2726 - protein, 9 aa, Artificial Sequence
  Description of Artificial Sequence: Synthetic peptide
  XENP020384 vhCDR3
TGHLGPFDL

SEQ ID NO: 2727 - protein, 12 aa, Artificial Sequence
  Description of Artificial Sequence: Synthetic peptide
  XENP020384 vlCDR1
RASQSVGSSYLA

SEQ ID NO: 2728 - protein, 7 aa, Artificial Sequence
  Description of Artificial Sequence: Synthetic peptide
  XENP020384 vlCDR2
GASSRAT

SEQ ID NO: 2729 - protein, 9 aa, Artificial Sequence
  Description of Artificial Sequence: Synthetic peptide
  XENP020384 vlCDR3
QQYGSSPWT

SEQ ID NO: 2730 - protein, 246 aa, Artificial Sequence
  Description of Artificial Sequence: Synthetic polypeptide
  XENP020385 [CTLA-4]_H3.4_L0.125_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSGKPGSGKPGSGKPGSGKPGSEIVLTQSPGTLSLSPGERATLSCRASQSVSSSYLAWYQQKPGQAPRLLIYGAFSRATGIPDRFSGSGSGTDFTLTISRLEPEDFAVYYCQQYGSSPWTFGQGTKVEIK

SEQ ID NO: 2731 - protein, 118 aa, Artificial Sequence; identical to SEQ ID NO: 2461
  Description of Artificial Sequence: Synthetic polypeptide
  VH of XENP020385

SEQ ID NO: 2732 - protein, 108 aa, Artificial Sequence; identical to SEQ ID NO: 1607
  Description of Artificial Sequence: Synthetic polypeptide
  VL of XENP020385

SEQ ID NO: 2733 - protein, 5 aa, Artificial Sequence
  Description of Artificial Sequence: Synthetic peptide
  XENP020385 vhCDR1
SYTMH

SEQ ID NO: 2734 - protein, 17 aa, Artificial Sequence
  Description of Artificial Sequence: Synthetic peptide
  XENP020385 vhCDR2
FISYDGNHKYYADSVKG

SEQ ID NO: 2735 - protein, 9 aa, Artificial Sequence
  Description of Artificial Sequence: Synthetic peptide
  XENP020385 vhCDR3
TGHLGPFDL

SEQ ID NO: 2736 - protein, 12 aa, Artificial Sequence
  Description of Artificial Sequence: Synthetic peptide
  XENP020385 vlCDR1
RASQSVSSSYLA

SEQ ID NO: 2737 - protein, 7 aa, Artificial Sequence
  Description of Artificial Sequence: Synthetic peptide
  XENP020385 vlCDR2
GAFSRAT

SEQ ID NO: 2738 - protein, 9 aa, Artificial Sequence
  Description of Artificial Sequence: Synthetic peptide
  XENP020385 vlCDR3
QQYGSSPWT

SEQ ID NO: 2739 - protein, 246 aa, Artificial Sequence
  Description of Artificial Sequence: Synthetic polypeptide
  XENP020386 [CTLA-4]_H3.4_L0.126_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSGKPGSGKPGSGKPGSGKPGSEIVLTQSPGTLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIK

SEQ ID NO: 2740 - protein, 118 aa, Artificial Sequence; identical to SEQ ID NO: 2461
  Description of Artificial Sequence: Synthetic polypeptide
  VH of XENP020386

SEQ ID NO: 2741 - protein, 108 aa, Artificial Sequence; identical to SEQ ID NO: 2066
  Description of Artificial Sequence: Synthetic polypeptide
  VL of XENP020386

SEQ ID NO: 2742 - protein, 5 aa, Artificial Sequence
  Description of Artificial Sequence: Synthetic peptide
  XENP020386 vhCDR1
SYTMH

SEQ ID NO: 2743 - protein, 17 aa, Artificial Sequence
  Description of Artificial Sequence: Synthetic peptide
  XENP020386 vhCDR2
FISYDGNHKYYADSVKG

SEQ ID NO: 2744 - protein, 9 aa, Artificial Sequence
  Description of Artificial Sequence: Synthetic peptide
  XENP020386 vhCDR3
TGHLGPFDL

SEQ ID NO: 2745 - protein, 12 aa, Artificial Sequence
  Description of Artificial Sequence: Synthetic peptide
  XENP020386 vlCDR1
RASQSVGSSYLA

SEQ ID NO: 2746 - protein, 7 aa, Artificial Sequence
  Description of Artificial Sequence: Synthetic peptide
  XENP020386 vlCDR2
GASSRAT

SEQ ID NO: 2747 - protein, 9 aa, Artificial Sequence
  Description of Artificial Sequence: Synthetic peptide
  XENP020386 vlCDR3
QQYGSSPWT

SEQ ID NO: 2748 - protein, 246 aa, Artificial Sequence
  Description of Artificial Sequence: Synthetic polypeptide
  XENP020387 [CTLA-4]_H3.4_L0.127_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSGKPGSGKPGSGKPGSGKPGSEIVLTQSPGTLSVSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 2749 - protein, 118 aa, Artificial Sequence; identical to SEQ ID NO: 2461
  Description of Artificial Sequence: Synthetic polypeptide
  VH of XENP020387

SEQ ID NO: 2750 - protein, 108 aa, Artificial Sequence
  Description of Artificial Sequence: Synthetic polypeptide
  VL of XENP020387
EIVLTQSPGTLSVSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 2751 - protein, 5 aa, Artificial Sequence
  Description of Artificial Sequence: Synthetic peptide
  XENP020387 vhCDR1
SYTMH

SEQ ID NO: 2752 - protein, 17 aa, Artificial Sequence
  Description of Artificial Sequence: Synthetic peptide
  XENP020387 vhCDR2
FISYDGNHKYYADSVKG

SEQ ID NO: 2753 - protein, 9 aa, Artificial Sequence
  Description of Artificial Sequence: Synthetic peptide
  XENP020387 vhCDR3
TGHLGPFDL

SEQ ID NO: 2754 - protein, 12 aa, Artificial Sequence
  Description of Artificial Sequence: Synthetic peptide
  XENP020387 vlCDR1
RASQSVSSSYLA

SEQ ID NO: 2755 - protein, 7 aa, Artificial Sequence
  Description of Artificial Sequence: Synthetic peptide
  XENP020387 vlCDR2
GASSRAT

SEQ ID NO: 2756 - protein, 9 aa, Artificial Sequence
  Description of Artificial Sequence: Synthetic peptide
  XENP020387 vlCDR3
QQYGSSPWT

SEQ ID NO: 2757 - protein, 246 aa, Artificial Sequence
  Description of Artificial Sequence: Synthetic polypeptide
  XENP020388 [CTLA-4]_H3.4_L0.128_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSGKPGSGKPGSGKPGSGKPGSEIVLTQSPATLSLSPGERATLSCRASQSVSSSYLAWYQQKPGQAPRLLIYGAFSRATGIPDRFSGSGSGTDFTLTISRLEPEDFAVYYCQQYGSSPWTFGQGTKVEIK

SEQ ID NO: 2758 - protein, 118 aa, Artificial Sequence; identical to SEQ ID NO: 2461
  Description of Artificial Sequence: Synthetic polypeptide
  VH of XENP020388

SEQ ID NO: 2759 - protein, 108 aa, Artificial Sequence
  Description of Artificial Sequence: Synthetic polypeptide
  VL of XENP020388
EIVLTQSPATLSLSPGERATLSCRASQSVSSSYLAWYQQKPGQAPRLLIYGAFSRATGIPDRFSGSGSGTDFTLTISRLEPEDFAVYYCQQYGSSPWTFGQGTKVEIK

SEQ ID NO: 2760 - protein, 5 aa, Artificial Sequence
  Description of Artificial Sequence: Synthetic peptide
  XENP020388 vhCDR1
SYTMH

SEQ ID NO: 2761 - protein, 17 aa, Artificial Sequence
  Description of Artificial Sequence: Synthetic peptide
  XENP020388 vhCDR2
FISYDGNHKYYADSVKG

SEQ ID NO: 2762 - protein, 9 aa, Artificial Sequence
  Description of Artificial Sequence: Synthetic peptide
  XENP020388 vhCDR3
TGHLGPFDL

SEQ ID NO: 2763 - protein, 12 aa, Artificial Sequence
  Description of Artificial Sequence: Synthetic peptide
  XENP020388 vlCDR1
RASQSVSSSYLA

SEQ ID NO: 2764 - protein, 7 aa, Artificial Sequence
  Description of Artificial Sequence: Synthetic peptide
  XENP020388 vlCDR2
GAFSRAT

SEQ ID NO: 2765 - protein, 9 aa, Artificial Sequence
  Description of Artificial Sequence: Synthetic peptide
  XENP020388 vlCDR3
QQYGSSPWT

SEQ ID NO: 2766 - protein, 246 aa, Artificial Sequence
  Description of Artificial Sequence: Synthetic polypeptide
  XENP020389 [CTLA-4]_H3.4_L0.129_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSGKPGSGKPGSGKPGSGKPGSEIVLTQSPATLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIK

SEQ ID NO: 2767 - protein, 118 aa, Artificial Sequence; identical to SEQ ID NO: 2461
  Description of Artificial Sequence: Synthetic polypeptide
  VH of XENP020389

SEQ ID NO: 2768 - protein, 108 aa, Artificial Sequence
  Description of Artificial Sequence: Synthetic polypeptide
  VL of XENP020389
EIVLTQSPATLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIK

SEQ ID NO: 2769 - protein, 5 aa, Artificial Sequence
  Description of Artificial Sequence: Synthetic peptide
  XENP020389 vhCDR1
SYTMH

SEQ ID NO: 2770 - protein, 17 aa, Artificial Sequence
  Description of Artificial Sequence: Synthetic peptide
  XENP020389 vhCDR2
FISYDGNHKYYADSVKG

SEQ ID NO: 2771 - protein, 9 aa, Artificial Sequence
  Description of Artificial Sequence: Synthetic peptide
  XENP020389 vhCDR3
TGHLGPFDL

SEQ ID NO: 2772 - protein, 12 aa, Artificial Sequence
  Description of Artificial Sequence: Synthetic peptide
  XENP020389 vlCDR1
RASQSVGSSYLA

SEQ ID NO: 2773 - protein, 7 aa, Artificial Sequence
  Description of Artificial Sequence: Synthetic peptide
  XENP020389 vlCDR2
GASSRAT

SEQ ID NO: 2774 - protein, 9 aa, Artificial Sequence
  Description of Artificial Sequence: Synthetic peptide
  XENP020389 vlCDR3
QQYGSSPWT

SEQ ID NO: 2775 - protein, 246 aa, Artificial Sequence
  Description of Artificial Sequence: Synthetic polypeptide
  XENP020390 [CTLA-4]_H3.4_L0.130_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSGKPGSGKPGSGKPGSGKPGSEIVLTQSPATLSVSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 2776 - protein, 118 aa, Artificial Sequence; identical to SEQ ID NO: 2461
  Description of Artificial Sequence: Synthetic polypeptide
  VH of XENP020390

SEQ ID NO: 2777 - protein, 108 aa, Artificial Sequence
  Description of Artificial Sequence: Synthetic polypeptide
  VL of XENP020390
EIVLTQSPATLSVSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 2778 - protein, 5 aa, Artificial Sequence
  Description of Artificial Sequence: Synthetic peptide
  XENP020390 vhCDR1
SYTMH

SEQ ID NO: 2779 - protein, 17 aa, Artificial Sequence
  Description of Artificial Sequence: Synthetic peptide
  XENP020390 vhCDR2
FISYDGNHKYYADSVKG

SEQ ID NO: 2780 - protein, 9 aa, Artificial Sequence
  Description of Artificial Sequence: Synthetic peptide
  XENP020390 vhCDR3
TGHLGPFDL

SEQ ID NO: 2781 - protein, 12 aa, Artificial Sequence
  Description of Artificial Sequence: Synthetic peptide
  XENP020390 vlCDR1
RASQSVSSSYLA

SEQ ID NO: 2782 - protein, 7 aa, Artificial Sequence
  Description of Artificial Sequence: Synthetic peptide
  XENP020390 vlCDR2
GASSRAT

SEQ ID NO: 2783 - protein, 9 aa, Artificial Sequence
  Description of Artificial Sequence: Synthetic peptide
  XENP020390 vlCDR3
QQYGSSPWT

SEQ ID NO: 2784 - protein, 246 aa, Artificial Sequence
  Description of Artificial Sequence: Synthetic polypeptide
  XENP020391 [CTLA-4]_H3.4_L0.131_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSGKPGSGKPGSGKPGSGKPGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 2785 - protein, 118 aa, Artificial Sequence; identical to SEQ ID NO: 2461
  Description of Artificial Sequence: Synthetic polypeptide
  VH of XENP020391

SEQ ID NO: 2786 - protein, 108 aa, Artificial Sequence
  Description of Artificial Sequence: Synthetic polypeptide
  VL of XENP020391
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 2787 - protein, 5 aa, Artificial Sequence
  Description of Artificial Sequence: Synthetic peptide
  XENP020391 vhCDR1
SYTMH

SEQ ID NO: 2788 - protein, 17 aa, Artificial Sequence
  Description of Artificial Sequence: Synthetic peptide
  XENP020391 vhCDR2
FISYDGNHKYYADSVKG

SEQ ID NO: 2789 - protein, 9 aa, Artificial Sequence
  Description of Artificial Sequence: Synthetic peptide
  XENP020391 vhCDR3
TGHLGPFDL

SEQ ID NO: 2790 - protein, 12 aa, Artificial Sequence
  Description of Artificial Sequence: Synthetic peptide
  XENP020391 vlCDR1
RASQSVSSSYLA

SEQ ID NO: 2791 - protein, 7 aa, Artificial Sequence
  Description of Artificial Sequence: Synthetic peptide
  XENP020391 vlCDR2
GASSRAT

SEQ ID NO: 2792 - protein, 9 aa, Artificial Sequence
  Description of Artificial Sequence: Synthetic peptide
  XENP020391 vlCDR3
QQYGSSPWT

SEQ ID NO: 2793 - protein, 246 aa, Artificial Sequence
  Description of Artificial Sequence: Synthetic polypeptide
  XENP020392 [CTLA-4]_H3.4_L0.132_scFv(GKPGS)4
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSGKPGSGKPGSGKPGSGKPGSEIVLTQSPATLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 2794 - protein, 118 aa, Artificial Sequence; identical to SEQ ID NO: 2461
  Description of Artificial Sequence: Synthetic polypeptide
  VH of XENP020392

SEQ ID NO: 2795 - protein, 108 aa, Artificial Sequence
  Description of Artificial Sequence: Synthetic polypeptide
  VL of XENP020392
EIVLTQSPATLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 2796 - protein, 5 aa, Artificial Sequence
  Description of Artificial Sequence: Synthetic peptide
  XENP020392 vhCDR1
SYTMH

SEQ ID NO: 2797 - protein, 17 aa, Artificial Sequence
  Description of Artificial Sequence: Synthetic peptide
  XENP020392 vhCDR2
FISYDGNHKYYADSVKG

SEQ ID NO: 2798 - protein, 9 aa, Artificial Sequence
  Description of Artificial Sequence: Synthetic peptide
  XENP020392 vhCDR3
TGHLGPFDL

SEQ ID NO: 2799 - protein, 12 aa, Artificial Sequence
  Description of Artificial Sequence: Synthetic peptide
  XENP020392 vlCDR1
RASQSVSSSYLA

SEQ ID NO: 2800 - protein, 7 aa, Artificial Sequence
  Description of Artificial Sequence: Synthetic peptide
  XENP020392 vlCDR2
GASSRAT

SEQ ID NO: 2801 - protein, 9 aa, Artificial Sequence
  Description of Artificial Sequence: Synthetic peptide
  XENP020392 vlCDR3
QQYGSSPWT

SEQ ID NO: 2802 - protein, 246 aa, Artificial Sequence
  Description of Artificial Sequence: Synthetic polypeptide
  XENP020393 [CTLA-4]_H3.5_L2_scFv(GKPGS)4
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTGHLGPFDLWGQGTMVTVSSGKPGSGKPGSGKPGSGKPGSEIVMTQSPATLSVSPGERATLSCRASQSVGSSYLAWYQQKPGQAPRLLIYGAFSRATGIPARFSGSGSGTEFTLTISSLQSEDFAVYYCQQYGSSPWTFGQGTKVEIK

SEQ ID NO: 2803 - protein, 118 aa, Artificial Sequence; identical to SEQ ID NO: 2470
  Description of Artificial Sequence: Synthetic polypeptide
  VH of XENP020393

SEQ ID NO: 2804 - protein, 108 aa, Artificial Sequence; identical to SEQ ID NO: 167
  Description of Artificial Sequence: Synthetic polypeptide
  VL of XENP020393

SEQ ID NO: 2805 - protein, 5 aa, Artificial Sequence
  Description of Artificial Sequence: Synthetic peptide
  XENP020393 vhCDR1
SYTMH

SEQ ID NO: 2806 - protein, 17 aa, Artificial Sequence
  Description of Artificial Sequence: Synthetic peptide
  XENP020393 vhCDR2
FISYDGNTKYYADSVKG

SEQ ID NO: 2807 - protein, 9 aa, Artificial Sequence
  Description of Artificial Sequence: Synthetic peptide
  XENP020393 vhCDR3
TGHLGPFDL

SEQ ID NO: 2808 - protein, 12 aa, Artificial Sequence
  Description of Artificial Sequence: Synthetic peptide
  XENP020393 vlCDR1
RASQSVGSSYLA

SEQ ID NO: 2809 - protein, 7 aa, Artificial Sequence
  Description of Artificial Sequence: Synthetic peptide
  XENP020393 vlCDR2
GAFSRAT

SEQ ID NO: 2810 - protein, 9 aa, Artificial Sequence
  Description of Artificial Sequence: Synthetic peptide
  XENP020393 vlCDR3
QQYGSSPWT

SEQ ID NO: 2811 - protein, 246 aa, Artificial Sequence
  Description of Artificial Sequence: Synthetic polypeptide
  XENP020394 [CTLA-4]_H3.5_L2.1_scFv(GKPGS)4
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTGHLGPFDLWGQGTMVTVSSGKPGSGKPGSGKPGSGKPGSEIVMTQSPATLSVSPGERATLSCRASQSVSSSYLAWYQQKPGQAPRLLIYGAFSRATGIPARFSGSGSGTEFTLTISSLQSEDFAVYYCQQYGSSPWTFGQGTKVEIK

SEQ ID NO: 2812 - protein, 118 aa, Artificial Sequence; identical to SEQ ID NO: 2470
  Description of Artificial Sequence: Synthetic polypeptide
  VH of XENP020394

SEQ ID NO: 2813 - protein, 108 aa, Artificial Sequence
  Description of Artificial Sequence: Synthetic polypeptide
  VL of XENP020394
EIVMTQSPATLSVSPGERATLSCRASQSVSSSYLAWYQQKPGQAPRLLIYGAFSRATGIPARFSGSGSGTEFTLTISSLQSEDFAVYYCQQYGSSPWTFGQGTKVEIK

SEQ ID NO: 2814 - protein, 5 aa, Artificial Sequence
  Description of Artificial Sequence: Synthetic peptide
  XENP020394 vhCDR1
SYTMH

SEQ ID NO: 2815 - protein, 17 aa, Artificial Sequence
  Description of Artificial Sequence: Synthetic peptide
  XENP020394 vhCDR2
FISYDGNTKYYADSVKG

SEQ ID NO: 2816 - protein, 9 aa, Artificial Sequence
  Description of Artificial Sequence: Synthetic peptide
  XENP020394 vhCDR3
TGHLGPFDL

SEQ ID NO: 2817 - protein, 12 aa, Artificial Sequence
  Description of Artificial Sequence: Synthetic peptide
  XENP020394 vlCDR1
RASQSVSSSYLA

SEQ ID NO: 2818 - protein, 7 aa, Artificial Sequence
  Description of Artificial Sequence: Synthetic peptide
  XENP020394 vlCDR2
GAFSRAT

SEQ ID NO: 2819 - protein, 9 aa, Artificial Sequence
  Description of Artificial Sequence: Synthetic peptide
  XENP020394 vlCDR3
QQYGSSPWT

SEQ ID NO: 2820 - protein, 246 aa, Artificial Sequence
  Description of Artificial Sequence: Synthetic polypeptide
  XENP020395 [CTLA-4]_H3.5_L2.2_scFv(GKPGS)4
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTGHLGPFDLWGQGTMVTVSSGKPGSGKPGSGKPGSGKPGSEIVMTQSPATLSVSPGERATLSCRASQSVGSSYLAWYQQKPGQAPRLLIYGASSRATGIPARFSGSGSGTEFTLTISSLQSEDFAVYYCQQYGSSPWTFGQGTKVEIK

SEQ ID NO: 2821 - protein, 118 aa, Artificial Sequence; identical to SEQ ID NO: 2470
  Description of Artificial Sequence: Synthetic polypeptide
  VH of XENP020395

SEQ ID NO: 2822 - protein, 108 aa, Artificial Sequence
  Description of Artificial Sequence: Synthetic polypeptide
  VL of XENP020395
EIVMTQSPATLSVSPGERATLSCRASQSVGSSYLAWYQQKPGQAPRLLIYGASSRATGIPARFSGSGSGTEFTLTISSLQSEDFAVYYCQQYGSSPWTFGQGTKVEIK

SEQ ID NO: 2823 - protein, 5 aa, Artificial Sequence
  Description of Artificial Sequence: Synthetic peptide
  XENP020395 vhCDR1
SYTMH

SEQ ID NO: 2824 - protein, 17 aa, Artificial Sequence
  Description of Artificial Sequence: Synthetic peptide
  XENP020395 vhCDR2
FISYDGNTKYYADSVKG

SEQ ID NO: 2825 - protein, 9 aa, Artificial Sequence
  Description of Artificial Sequence: Synthetic peptide
  XENP020395 vhCDR3
TGHLGPFDL

SEQ ID NO: 2826 - protein, 12 aa, Artificial Sequence
  Description of Artificial Sequence: Synthetic peptide
  XENP020395 vlCDR1
RASQSVGSSYLA

SEQ ID NO: 2827 - protein, 7 aa, Artificial Sequence
  Description of Artificial Sequence: Synthetic peptide
  XENP020395 vlCDR2
GASSRAT

SEQ ID NO: 2828 - protein, 9 aa, Artificial Sequence
  Description of Artificial Sequence: Synthetic peptide
  XENP020395 vlCDR3
QQYGSSPWT

SEQ ID NO: 2829 - protein, 246 aa, Artificial Sequence
  Description of Artificial Sequence: Synthetic polypeptide
  XENP020396 [CTLA-4]_H3.5_L2.3_scFv(GKPGS)4
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTGHLGPFDLWGQGTMVTVSSGKPGSGKPGSGKPGSGKPGSEIVMTQSPATLSVSPGERATLSCRASQSVSSSYLAWYQQKPGQAPRLLIYGASSRATGIPARFSGSGSGTEFTLTISSLQSEDFAVYYCQQYGSSPWTFGQGTKVEIK

SEQ ID NO: 2830 - protein, 118 aa, Artificial Sequence; identical to SEQ ID NO: 2470
  Description of Artificial Sequence: Synthetic polypeptide
  VH of XENP020396

SEQ ID NO: 2831 - protein, 108 aa, Artificial Sequence
  Description of Artificial Sequence: Synthetic polypeptide
  VL of XENP020396
EIVMTQSPATLSVSPGERATLSCRASQSVSSSYLAWYQQKPGQAPRLLIYGASSRATGIPARFSGSGSGTEFTLTISSLQSEDFAVYYCQQYGSSPWTFGQGTKVEIK

SEQ ID NO: 2832 - protein, 5 aa, Artificial Sequence
  Description of Artificial Sequence: Synthetic peptide
  XENP020396 vhCDR1
SYTMH

SEQ ID NO: 2833 - protein, 17 aa, Artificial Sequence
  Description of Artificial Sequence: Synthetic peptide
  XENP020396 vhCDR2
FISYDGNTKYYADSVKG

SEQ ID NO: 2834 - protein, 9 aa, Artificial Sequence
  Description of Artificial Sequence: Synthetic peptide
  XENP020396 vhCDR3
TGHLGPFDL

SEQ ID NO: 2835 - protein, 12 aa, Artificial Sequence
  Description of Artificial Sequence: Synthetic peptide
  XENP020396 vlCDR1
RASQSVSSSYLA

SEQ ID NO: 2836 - protein, 7 aa, Artificial Sequence
  Description of Artificial Sequence: Synthetic peptide
  XENP020396 vlCDR2
GASSRAT

SEQ ID NO: 2837 - protein, 9 aa, Artificial Sequence
  Description of Artificial Sequence: Synthetic peptide
  XENP020396 vlCDR3
QQYGSSPWT

SEQ ID NO: 2838 - protein, 246 aa, Artificial Sequence
  Description of Artificial Sequence: Synthetic polypeptide
  XENP020431 [CTLA-4]_H3.21_L0.124_scFv(GKPGS)4
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARGGLLGPFDLWGQGTMVTVSSGKPGSGKPGSGKPGSGKPGSEIVLTQSPATLSVSPGERATLSCRASQSVGSSYLAWYQQKPGQAPRLLIYGASSRATGIPDRFSGSGSGTDFTLTISRLEPEDFAVYYCQQYGSSPWTFGQGTKVEIK

SEQ ID NO: 2839 - protein, 118 aa, Artificial Sequence; identical to SEQ ID NO: 2614
  Description of Artificial Sequence: Synthetic polypeptide
  VH of XENP020431

SEQ ID NO: 2840 - protein, 108 aa, Artificial Sequence; identical to SEQ ID NO: 2723
  Description of Artificial Sequence: Synthetic polypeptide
  VL of XENP020431

SEQ ID NO: 2841 - protein, 5 aa, Artificial Sequence
  Description of Artificial Sequence: Synthetic peptide
  XENP020431 vhCDR1
SYTMH

SEQ ID NO: 2842 - protein, 17 aa, Artificial Sequence
  Description of Artificial Sequence: Synthetic peptide
  XENP020431 vhCDR2
FISYDGNTKYYADSVKG

SEQ ID NO: 2843 - protein, 9 aa, Artificial Sequence
  Description of Artificial Sequence: Synthetic peptide
  XENP020431 vhCDR3
GGLLGPFDL

SEQ ID NO: 2844 - protein, 12 aa, Artificial Sequence
  Description of Artificial Sequence: Synthetic peptide
  XENP020431 vlCDR1
RASQSVGSSYLA

SEQ ID NO: 2845 - protein, 7 aa, Artificial Sequence
  Description of Artificial Sequence: Synthetic peptide
  XENP020431 vlCDR2
GASSRAT

SEQ ID NO: 2846 - protein, 9 aa, Artificial Sequence
  Description of Artificial Sequence: Synthetic peptide
  XENP020431 vlCDR3
QQYGSSPWT

SEQ ID NO: 2847 - protein, 246 aa, Artificial Sequence
  Description of Artificial Sequence: Synthetic polypeptide
  XENP020432 [CTLA-4]_H3.21_L0.129_scFv(GKPGS)4
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARGGLLGPFDLWGQGTMVTVSSGKPGSGKPGSGKPGSGKPGSEIVLTQSPATLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIK

SEQ ID NO: 2848 - protein, 118 aa, Artificial Sequence; identical to SEQ ID NO: 2614
  Description of Artificial Sequence: Synthetic polypeptide
  VH of XENP020432

SEQ ID NO: 2849 - protein, 108 aa, Artificial Sequence; identical to SEQ ID NO: 2768
  Description of Artificial Sequence: Synthetic polypeptide
  VL of XENP020432

SEQ ID NO: 2850 - protein, 5 aa, Artificial Sequence
  Description of Artificial Sequence: Synthetic peptide
  XENP020432 vhCDR1
SYTMH

SEQ ID NO: 2851 - protein, 17 aa, Artificial Sequence
  Description of Artificial Sequence: Synthetic peptide
  XENP020432 vhCDR2
FISYDGNTKYYADSVKG

SEQ ID NO: 2852 - protein, 9 aa, Artificial Sequence
  Description of Artificial Sequence: Synthetic peptide
  XENP020432 vhCDR3
GGLLGPFDL

SEQ ID NO: 2853 - protein, 12 aa, Artificial Sequence
  Description of Artificial Sequence: Synthetic peptide
  XENP020432 vlCDR1
RASQSVGSSYLA

SEQ ID NO: 2854 - protein, 7 aa, Artificial Sequence
  Description of Artificial Sequence: Synthetic peptide
  XENP020432 vlCDR2
GASSRAT

SEQ ID NO: 2855 - protein, 9 aa, Artificial Sequence
  Description of Artificial Sequence: Synthetic peptide
  XENP020432 vlCDR3
QQYGSSPWT

SEQ ID NO: 2856 - protein, 246 aa, Artificial Sequence
  Description of Artificial Sequence: Synthetic polypeptide
  XENP020433 [CTLA-4]_H3.21_L0.132_scFv(GKPGS)4
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARGGLLGPFDLWGQGTMVTVSSGKPGSGKPGSGKPGSGKPGSEIVLTQSPATLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 2857 - protein, 118 aa, Artificial Sequence; identical to SEQ ID NO: 2614
  Description of Artificial Sequence: Synthetic polypeptide
  VH of XENP020433

SEQ ID NO: 2858 - protein, 108 aa, Artificial Sequence; identical to SEQ ID NO: 2795
  Description of Artificial Sequence: Synthetic polypeptide
  VL of XENP020433

SEQ ID NO: 2859 - protein, 5 aa, Artificial Sequence
  Description of Artificial Sequence: Synthetic peptide
  XENP020433 vhCDR1
SYTMH

SEQ ID NO: 2860 - protein, 17 aa, Artificial Sequence
  Description of Artificial Sequence: Synthetic peptide
  XENP020433 vhCDR2
FISYDGNTKYYADSVKG

SEQ ID NO: 2861 - protein, 9 aa, Artificial Sequence
  Description of Artificial Sequence: Synthetic peptide
  XENP020433 vhCDR3
GGLLGPFDL

SEQ ID NO: 2862 - protein, 12 aa, Artificial Sequence
  Description of Artificial Sequence: Synthetic peptide
  XENP020433 vlCDR1
RASQSVSSSYLA

SEQ ID NO: 2863 - protein, 7 aa, Artificial Sequence
  Description of Artificial Sequence: Synthetic peptide
  XENP020433 vlCDR2
GASSRAT

SEQ ID NO: 2864 - protein, 9 aa, Artificial Sequence
  Description of Artificial Sequence: Synthetic peptide
  XENP020433 vlCDR3
QQYGSSPWT

SEQ ID NO: 2865 - protein, 246 aa, Artificial Sequence
  Description of Artificial Sequence: Synthetic polypeptide
  XENP020434 [CTLA-4]_H3.23_L0.124_scFv(GKPGS)4
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGHLGPFDLWGQGTMVTVSSGKPGSGKPGSGKPGSGKPGSEIVLTQSPATLSVSPGERATLSCRASQSVGSSYLAWYQQKPGQAPRLLIYGASSRATGIPDRFSGSGSGTDFTLTISRLEPEDFAVYYCQQYGSSPWTFGQGTKVEIK

SEQ ID NO: 2866 - protein, 118 aa, Artificial Sequence; identical to SEQ ID NO: 2632
  Description of Artificial Sequence: Synthetic polypeptide
  VH of XENP020434

SEQ ID NO: 2867 - protein, 108 aa, Artificial Sequence; identical to SEQ ID NO: 2723
  Description of Artificial Sequence: Synthetic polypeptide
  VL of XENP020434

SEQ ID NO: 2868 - protein, 5 aa, Artificial Sequence
  Description of Artificial Sequence: Synthetic peptide
  XENP020434 vhCDR1
SYTMH

SEQ ID NO: 2869 - protein, 17 aa, Artificial Sequence
  Description of Artificial Sequence: Synthetic peptide
  XENP020434 vhCDR2
FISYDGNYKYYADSVKG

SEQ ID NO: 2870 - protein, 9 aa, Artificial Sequence
  Description of Artificial Sequence: Synthetic peptide
  XENP020434 vhCDR3
GGHLGPFDL

SEQ ID NO: 2871 - protein, 12 aa, Artificial Sequence
  Description of Artificial Sequence: Synthetic peptide
  XENP020434 vlCDR1
RASQSVGSSYLA

SEQ ID NO: 2872 - protein, 7 aa, Artificial Sequence
  Description of Artificial Sequence: Synthetic peptide
  XENP020434 vlCDR2
GASSRAT

SEQ ID NO: 2873 - protein, 9 aa, Artificial Sequence
  Description of Artificial Sequence: Synthetic peptide
  XENP020434 vlCDR3
QQYGSSPWT

SEQ ID NO: 2874 - protein, 246 aa, Artificial Sequence
  Description of Artificial Sequence: Synthetic polypeptide
  XENP020435 [CTLA-4]_H3.23_L0.129_scFv(GKPGS)4
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGHLGPFDLWGQGTMVTVSSGKPGSGKPGSGKPGSGKPGSEIVLTQSPATLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIK

SEQ ID NO: 2875 - protein, 118 aa, Artificial Sequence; identical to SEQ ID NO: 2632
  Description of Artificial Sequence: Synthetic polypeptide
  VH of XENP020435

SEQ ID NO: 2876 - protein, 108 aa, Artificial Sequence; identical to SEQ ID NO: 2768
  Description of Artificial Sequence: Synthetic polypeptide
  VL of XENP020435

SEQ ID NO: 2877 - protein, 5 aa, Artificial Sequence
  Description of Artificial Sequence: Synthetic peptide
  XENP020435 vhCDR1
SYTMH

SEQ ID NO: 2878 - protein, 17 aa, Artificial Sequence
  Description of Artificial Sequence: Synthetic peptide
  XENP020435 vhCDR2
FISYDGNYKYYADSVKG

SEQ ID NO: 2879 - protein, 9 aa, Artificial Sequence
  Description of Artificial Sequence: Synthetic peptide
  XENP020435 vhCDR3
GGHLGPFDL

SEQ ID NO: 2880 - protein, 12 aa, Artificial Sequence
  Description of Artificial Sequence: Synthetic peptide
  XENP020435 vlCDR1
RASQSVGSSYLA

SEQ ID NO: 2881 - protein, 7 aa, Artificial Sequence
  Description of Artificial Sequence: Synthetic peptide
  XENP020435 vlCDR2
GASSRAT

SEQ ID NO: 2882 - protein, 9 aa, Artificial Sequence
  Description of Artificial Sequence: Synthetic peptide
  XENP020435 vlCDR3
QQYGSSPWT

SEQ ID NO: 2883 - protein, 246 aa, Artificial Sequence
  Description of Artificial Sequence: Synthetic polypeptide
  XENP020436 [CTLA-4]_H3.23_L0.132_scFv(GKPGS)4
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGHLGPFDLWGQGTMVTVSSGKPGSGKPGSGKPGSGKPGSEIVLTQSPATLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 2884 - protein, 118 aa, Artificial Sequence; identical to SEQ ID NO: 2632
  Description of Artificial Sequence: Synthetic polypeptide
  VH of XENP020436

SEQ ID NO: 2885 - protein, 108 aa, Artificial Sequence; identical to SEQ ID NO: 2795
  Description of Artificial Sequence: Synthetic polypeptide
  VL of XENP020436

SEQ ID NO: 2886 - protein, 5 aa, Artificial Sequence
  Description of Artificial Sequence: Synthetic peptide
  XENP020436 vhCDR1
SYTMH

SEQ ID NO: 2887 - protein, 17 aa, Artificial Sequence
  Description of Artificial Sequence: Synthetic peptide
  XENP020436 vhCDR2
FISYDGNYKYYADSVKG

SEQ ID NO: 2888 - protein, 9 aa, Artificial Sequence
  Description of Artificial Sequence: Synthetic peptide
  XENP020436 vhCDR3
GGHLGPFDL

SEQ ID NO: 2889 - protein, 12 aa, Artificial Sequence
  Description of Artificial Sequence: Synthetic peptide
  XENP020436 vlCDR1
RASQSVSSSYLA

SEQ ID NO: 2890 - protein, 7 aa, Artificial Sequence
  Description of Artificial Sequence: Synthetic peptide
  XENP020436 vlCDR2
GASSRAT

SEQ ID NO: 2891 - protein, 9 aa, Artificial Sequence
  Description of Artificial Sequence: Synthetic peptide
  XENP020436 vlCDR3
QQYGSSPWT

SEQ ID NO: 2892 - protein, 246 aa, Artificial Sequence
  Description of Artificial Sequence: Synthetic polypeptide
  XENP020437 [CTLA-4]_H3.25_L0.124_scFv(GKPGS)4
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGLLGPFDLWGQGTMVTVSSGKPGSGKPGSGKPGSGKPGSEIVLTQSPATLSVSPGERATLSCRASQSVGSSYLAWYQQKPGQAPRLLIYGASSRATGIPDRFSGSGSGTDFTLTISRLEPEDFAVYYCQQYGSSPWTFGQGTKVEIK

SEQ ID NO: 2893 - protein, 118 aa, Artificial Sequence; identical to SEQ ID NO: 2650
  Description of Artificial Sequence: Synthetic polypeptide
  VH of XENP020437

SEQ ID NO: 2894 - protein, 108 aa, Artificial Sequence; identical to SEQ ID NO: 2723
  Description of Artificial Sequence: Synthetic polypeptide
  VL of XENP020437

SEQ ID NO: 2895 - protein, 5 aa, Artificial Sequence
  Description of Artificial Sequence: Synthetic peptide
  XENP020437 vhCDR1
SYTMH

SEQ ID NO: 2896 - protein, 17 aa, Artificial Sequence
  Description of Artificial Sequence: Synthetic peptide
  XENP020437 vhCDR2
FISYDGNYKYYADSVKG

SEQ ID NO: 2897 - protein, 9 aa, Artificial Sequence
  Description of Artificial Sequence: Synthetic peptide
  XENP020437 vhCDR3
GGLLGPFDL

SEQ ID NO: 2898 - protein, 12 aa, Artificial Sequence
  Description of Artificial Sequence: Synthetic peptide
  XENP020437 vlCDR1
RASQSVGSSYLA

SEQ ID NO: 2899 - protein, 7 aa, Artificial Sequence
  Description of Artificial Sequence: Synthetic peptide
  XENP020437 vlCDR2
GASSRAT

SEQ ID NO: 2900 - protein, 9 aa, Artificial Sequence
  Description of Artificial Sequence: Synthetic peptide
  XENP020437 vlCDR3
QQYGSSPWT

SEQ ID NO: 2901 - protein, 246 aa, Artificial Sequence
  Description of Artificial Sequence: Synthetic polypeptide
  XENP020438 [CTLA-4]_H3.25_L0.129_scFv(GKPGS)4
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGLLGPFDLWGQGTMVTVSSGKPGSGKPGSGKPGSGKPGSEIVLTQSPATLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIK

SEQ ID NO: 2902 - protein, 118 aa, Artificial Sequence; identical to SEQ ID NO: 2650
  Description of Artificial Sequence: Synthetic polypeptide
  VH of XENP020438

SEQ ID NO: 2903 - protein, 108 aa, Artificial Sequence; identical to SEQ ID NO: 2768
  Description of Artificial Sequence: Synthetic polypeptide
  VL of XENP020438

SEQ ID NO: 2904 - protein, 5 aa, Artificial Sequence
  Description of Artificial Sequence: Synthetic peptide
  XENP020438 vhCDR1
SYTMH

SEQ ID NO: 2905 - protein, 17 aa, Artificial Sequence
  Description of Artificial Sequence: Synthetic peptide
  XENP020438 vhCDR2
FISYDGNYKYYADSVKG

SEQ ID NO: 2906 - protein, 9 aa, Artificial Sequence
  Description of Artificial Sequence: Synthetic peptide
  XENP020438 vhCDR3
GGLLGPFDL

SEQ ID NO: 2907 - protein, 12 aa, Artificial Sequence
  Description of Artificial Sequence: Synthetic peptide
  XENP020438 vlCDR1
RASQSVGSSYLA

SEQ ID NO: 2908 - protein, 7 aa, Artificial Sequence
  Description of Artificial Sequence: Synthetic peptide
  XENP020438 vlCDR2
GASSRAT

SEQ ID NO: 2909 - protein, 9 aa, Artificial Sequence
  Description of Artificial Sequence: Synthetic peptide
  XENP020438 vlCDR3
QQYGSSPWT

SEQ ID NO: 2910 - protein, 246 aa, Artificial Sequence
  Description of Artificial Sequence: Synthetic polypeptide
  XENP020439 [CTLA-4]_H3.25_L0.132_scFv(GKPGS)4
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGLLGPFDLWGQGTMVTVSSGKPGSGKPGSGKPGSGKPGSEIVLTQSPATLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 2911 - protein, 118 aa, Artificial Sequence; identical to SEQ ID NO: 2650
  Description of Artificial Sequence: Synthetic polypeptide
  VH of XENP020439

SEQ ID NO: 2912 - protein, 108 aa, Artificial Sequence; identical to SEQ ID NO: 2795
  Description of Artificial Sequence: Synthetic polypeptide
  VL of XENP020439

SEQ ID NO: 2913 - protein, 5 aa, Artificial Sequence
  Description of Artificial Sequence: Synthetic peptide
  XENP020439 vhCDR1
SYTMH

SEQ ID NO: 2914 - protein, 17 aa, Artificial Sequence
  Description of Artificial Sequence: Synthetic peptide
  XENP020439 vhCDR2
FISYDGNYKYYADSVKG

SEQ ID NO: 2915 - protein, 9 aa, Artificial Sequence
  Description of Artificial Sequence: Synthetic peptide
  XENP020439 vhCDR3
GGLLGPFDL

SEQ ID NO: 2916 - protein, 12 aa, Artificial Sequence
  Description of Artificial Sequence: Synthetic peptide
  XENP020439 vlCDR1
RASQSVSSSYLA

SEQ ID NO: 2917 - protein, 7 aa, Artificial Sequence
  Description of Artificial Sequence: Synthetic peptide
  XENP020439 vlCDR2
GASSRAT

SEQ ID NO: 2918 - protein, 9 aa, Artificial Sequence
  Description of Artificial Sequence: Synthetic peptide
  XENP020439 vlCDR3
QQYGSSPWT

SEQ ID NO: 2919 - protein, 221 aa, Artificial Sequence
  Description of Artificial Sequence: Synthetic polypeptide
  XENP009950 [CTLA-4]_H0_L0_Fab_Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 2920 - protein, 118 aa, Artificial Sequence; identical to SEQ ID NO: 22
  Description of Artificial Sequence: Synthetic polypeptide
  VH of XENP009950

SEQ ID NO: 2921 - protein, 5 aa, Artificial Sequence
  Description of Artificial Sequence: Synthetic peptide
  XENP009950 vhCDR1
SYTMH

SEQ ID NO: 2922 - protein, 17 aa, Artificial Sequence
  Description of Artificial Sequence: Synthetic peptide
  XENP009950 vhCDR2
FISYDGNNKYYADSVKG

SEQ ID NO: 2923 - protein, 9 aa, Artificial Sequence
  Description of Artificial Sequence: Synthetic peptide
  XENP009950 vhCDR3
TGWLGPFDY

SEQ ID NO: 2924 - protein, 215 aa, Artificial Sequence
  Description of Artificial Sequence: Synthetic polypeptide
  XENP009950 [CTLA-4]_H0_L0_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2925 - protein, 108 aa, Artificial Sequence; identical to SEQ ID NO: 23
  Description of Artificial Sequence: Synthetic polypeptide
  VL of XENP009950

SEQ ID NO: 2926 - protein, 12 aa, Artificial Sequence
  Description of Artificial Sequence: Synthetic peptide
  XENP009950 vlCDR1
RASQSVGSSYLA

SEQ ID NO: 2927 - protein, 7 aa, Artificial Sequence
  Description of Artificial Sequence: Synthetic peptide
  XENP009950 vlCDR2
GAFSRAT

SEQ ID NO: 2928 - protein, 9 aa, Artificial Sequence
  Description of Artificial Sequence: Synthetic peptide
  XENP009950 vlCDR3
QQYGSSPWT

SEQ ID NO: 2929 - protein, 221 aa, Artificial Sequence
  Description of Artificial Sequence: Synthetic polypeptide
  XENP019211 [CTLA-4]_H0.1_L0_Fab Heavy Chain
EVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 2930 - protein, 118 aa, Artificial Sequence; identical to SEQ ID NO: 193
  Description of Artificial Sequence: Synthetic polypeptide
  VH of XENP019211

SEQ ID NO: 2931 - protein, 5 aa, Artificial Sequence
  Description of Artificial Sequence: Synthetic peptide
  XENP019211 vhCDR1
SYTMH

SEQ ID NO: 2932 - protein, 17 aa, Artificial Sequence
  Description of Artificial Sequence: Synthetic peptide
  XENP019211 vhCDR2
FISYDGNNKYYADSVKG

SEQ ID NO: 2933 - protein, 9 aa, Artificial Sequence
  Description of Artificial Sequence: Synthetic peptide
  XENP019211 vhCDR3
TGWLGPFDY

SEQ ID NO: 2934 - protein, 215 aa, Artificial Sequence; identical to SEQ ID NO: 2924
  Description of Artificial Sequence: Synthetic polypeptide
  XENP019211 [CTLA-4]_H0.1_L0_Fab Light Chain

SEQ ID NO: 2935 - protein, 108 aa, Artificial Sequence; identical to SEQ ID NO: 23
  Description of Artificial Sequence: Synthetic polypeptide
  VL of XENP019211

SEQ ID NO: 2936 - protein, 12 aa, Artificial Sequence
  Description of Artificial Sequence: Synthetic peptide
  XENP019211 vlCDR1
RASQSVGSSYLA

SEQ ID NO: 2937 - protein, 7 aa, Artificial Sequence
  Description of Artificial Sequence: Synthetic peptide
  XENP019211 vlCDR2
GAFSRAT

SEQ ID NO: 2938 - protein, 9 aa, Artificial Sequence
  Description of Artificial Sequence: Synthetic peptide
  XENP019211 vlCDR3
QQYGSSPWT

SEQ ID NO: 2939 - protein, 221 aa, Artificial Sequence
  Description of Artificial Sequence: Synthetic polypeptide
  XENP019212 [CTLA-4]_H0.2_L0_Fab Heavy Chain
QVQLLESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 2940 - protein, 118 aa, Artificial Sequence; identical to SEQ ID NO: 202
  Description of Artificial Sequence: Synthetic polypeptide
  VH of XENP019212

SEQ ID NO: 2941 - protein, 5 aa, Artificial Sequence
  Description of Artificial Sequence: Synthetic peptide
  XENP019212 vhCDR1
SYTMH

SEQ ID NO: 2942 - protein, 17 aa, Artificial Sequence
  Description of Artificial Sequence: Synthetic peptide
  XENP019212 vhCDR2
FISYDGNNKYYADSVKG

SEQ ID NO: 2943 - protein, 9 aa, Artificial Sequence
  Description of Artificial Sequence: Synthetic peptide
  XENP019212 vhCDR3
TGWLGPFDY

SEQ ID NO: 2944 - protein, 215 aa, Artificial Sequence; identical to SEQ ID NO: 2924
  Description of Artificial Sequence: Synthetic polypeptide
  XENP019212 [CTLA-4]_H0.2_L0_Fab Light Chain

SEQ ID NO: 2945 - protein, 108 aa, Artificial Sequence; identical to SEQ ID NO: 23
  Description of Artificial Sequence: Synthetic polypeptide
  VL of XENP019212

SEQ ID NO: 2946 - protein, 12 aa, Artificial Sequence
  Description of Artificial Sequence: Synthetic peptide
  XENP019212 vlCDR1
RASQSVGSSYLA

SEQ ID NO: 2947 - protein, 7 aa, Artificial Sequence
  Description of Artificial Sequence: Synthetic peptide
  XENP019212 vlCDR2
GAFSRAT

SEQ ID NO: 2948 - protein, 9 aa, Artificial Sequence
  Description of Artificial Sequence: Synthetic peptide
  XENP019212 vlCDR3
QQYGSSPWT

SEQ ID NO: 2949 - protein, 221 aa, Artificial Sequence
  Description of Artificial Sequence: Synthetic polypeptide
  XENP019213 [CTLA-4]_H0.3_L0_Fab Heavy Chain
QVQLVESGGGLVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 2950 - protein, 118 aa, Artificial Sequence; identical to SEQ ID NO: 211
  Description of Artificial Sequence: Synthetic polypeptide
  VH of XENP019213

SEQ ID NO: 2951 - protein, 5 aa, Artificial Sequence
  Description of Artificial Sequence: Synthetic peptide
  XENP019213 vhCDR1
SYTMH

SEQ ID NO: 2952 - protein, 17 aa, Artificial Sequence
  Description of Artificial Sequence: Synthetic peptide
  XENP019213 vhCDR2
FISYDGNNKYYADSVKG

SEQ ID NO: 2953 - protein, 9 aa, Artificial Sequence
  Description of Artificial Sequence: Synthetic peptide
  XENP019213 vhCDR3
TGWLGPFDY

SEQ ID NO: 2954 - protein, 215 aa, Artificial Sequence; identical to SEQ ID NO: 2924
  Description of Artificial Sequence: Synthetic polypeptide
  XENP019213 [CTLA-4]_H0.3_L0_Fab Light Chain

SEQ ID NO: 2955 - protein, 108 aa, Artificial Sequence; identical to SEQ ID NO: 23
  Description of Artificial Sequence: Synthetic polypeptide
  VL of XENP019213

SEQ ID NO: 2956 - protein, 12 aa, Artificial Sequence
  Description of Artificial Sequence: Synthetic peptide
  XENP019213 vlCDR1
RASQSVGSSYLA

SEQ ID NO: 2957 - protein, 7 aa, Artificial Sequence
  Description of Artificial Sequence: Synthetic peptide
  XENP019213 vlCDR2
GAFSRAT

SEQ ID NO: 2958 - protein, 9 aa, Artificial Sequence
  Description of Artificial Sequence: Synthetic peptide
  XENP019213 vlCDR3
QQYGSSPWT

SEQ ID NO: 2959 - protein, 221 aa, Artificial Sequence
  Description of Artificial Sequence: Synthetic polypeptide
  XENP019214 [CTLA-4]_H0.4_L0_Fab Heavy Chain
QVQLVESGGGVKQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 2960 - protein, 118 aa, Artificial Sequence; identical to SEQ ID NO: 220
  Description of Artificial Sequence: Synthetic polypeptide
  VH of XENP019214

SEQ ID NO: 2961 - protein, 5 aa, Artificial Sequence
  Description of Artificial Sequence: Synthetic peptide
  XENP019214 vhCDR1
SYTMH

SEQ ID NO: 2962 - protein, 17 aa, Artificial Sequence
  Description of Artificial Sequence: Synthetic peptide
  XENP019214 vhCDR2
FISYDGNNKYYADSVKG

SEQ ID NO: 2963 - protein, 9 aa, Artificial Sequence
  Description of Artificial Sequence: Synthetic peptide
  XENP019214 vhCDR3
TGWLGPFDY

SEQ ID NO: 2964 - protein, 215 aa, Artificial Sequence; identical to SEQ ID NO: 2924
  Description of Artificial Sequence: Synthetic polypeptide
  XENP019214 [CTLA-4]_H0.4_L0_Fab Light Chain

SEQ ID NO: 2965 - protein, 108 aa, Artificial Sequence; identical to SEQ ID NO: 23
  Description of Artificial Sequence: Synthetic polypeptide
  VL of XENP019214

SEQ ID NO: 2966 - protein, 12 aa, Artificial Sequence
  Description of Artificial Sequence: Synthetic peptide
  XENP019214 vlCDR1
RASQSVGSSYLA

SEQ ID NO: 2967 - protein, 7 aa, Artificial Sequence
  Description of Artificial Sequence: Synthetic peptide
  XENP019214 vlCDR2
GAFSRAT

SEQ ID NO: 2968 - protein, 9 aa, Artificial Sequence
  Description of Artificial Sequence: Synthetic peptide
  XENP019214 vlCDR3
QQYGSSPWT

SEQ ID NO: 2969 - protein, 221 aa, Artificial Sequence
  Description of Artificial Sequence: Synthetic polypeptide
  XENP019215 [CTLA-4]_H0.5_L0_Fab Heavy Chain
QVQLVESGGGVKQPGESLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 2970 - protein, 118 aa, Artificial Sequence; identical to SEQ ID NO: 229
  Description of Artificial Sequence: Synthetic polypeptide
  VH of XENP019215

SEQ ID NO: 2971 - protein, 5 aa, Artificial Sequence
  Description of Artificial Sequence: Synthetic peptide
  XENP019215 vhCDR1
SYTMH

SEQ ID NO: 2972 - protein, 17 aa, Artificial Sequence
  Description of Artificial Sequence: Synthetic peptide
  XENP019215 vhCDR2
FISYDGNNKYYADSVKG

SEQ ID NO: 2973 - protein, 9 aa, Artificial Sequence
  Description of Artificial Sequence: Synthetic peptide
  XENP019215 vhCDR3
TGWLGPFDY

SEQ ID NO: 2974 - protein, 215 aa, Artificial Sequence; identical to SEQ ID NO: 2924
  Description of Artificial Sequence: Synthetic polypeptide
  XENP019215 [CTLA-4]_H0.5_L0_Fab Light Chain

SEQ ID NO: 2975 - protein, 108 aa, Artificial Sequence; identical to SEQ ID NO: 23
  Description of Artificial Sequence: Synthetic polypeptide
  VL of XENP019215

SEQ ID NO: 2976 - protein, 12 aa, Artificial Sequence
  Description of Artificial Sequence: Synthetic peptide
  XENP019215 vlCDR1
RASQSVGSSYLA

SEQ ID NO: 2977 - protein, 7 aa, Artificial Sequence
  Description of Artificial Sequence: Synthetic peptide
  XENP019215 vlCDR2
GAFSRAT

SEQ ID NO: 2978 - protein, 9 aa, Artificial Sequence
  Description of Artificial Sequence: Synthetic peptide
  XENP019215 vlCDR3
QQYGSSPWT

SEQ ID NO: 2979 - protein, 221 aa, Artificial Sequence
  Description of Artificial Sequence: Synthetic polypeptide
  XENP019216 [CTLA-4]_H0.6_L0_Fab Heavy Chain
QVQLVESGGGVVKPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 2980 - protein, 118 aa, Artificial Sequence; identical to SEQ ID NO: 238
  Description of Artificial Sequence: Synthetic polypeptide
  VH of XENP019216

SEQ ID NO: 2981 - protein, 5 aa, Artificial Sequence
  Description of Artificial Sequence: Synthetic peptide
  XENP019216 vhCDR1
SYTMH

SEQ ID NO: 2982 - protein, 17 aa, Artificial Sequence
  Description of Artificial Sequence: Synthetic peptide
  XENP019216 vhCDR2
FISYDGNNKYYADSVKG

SEQ ID NO: 2983 - protein, 9 aa, Artificial Sequence
  Description of Artificial Sequence: Synthetic peptide
  XENP019216 vhCDR3
TGWLGPFDY

SEQ ID NO: 2984 - protein, 215 aa, Artificial Sequence; identical to SEQ ID NO: 2924
  Description of Artificial Sequence: Synthetic polypeptide
  XENP019216 [CTLA-4]_H0.6_L0_Fab Light Chain

SEQ ID NO: 2985 - protein, 108 aa, Artificial Sequence; identical to SEQ ID NO: 23
  Description of Artificial Sequence: Synthetic polypeptide
  VL of XENP019216

SEQ ID NO: 2986 - protein, 12 aa, Artificial Sequence
  Description of Artificial Sequence: Synthetic peptide
  XENP019216 vlCDR1
RASQSVGSSYLA

SEQ ID NO: 2987 - protein, 7 aa, Artificial Sequence
  Description of Artificial Sequence: Synthetic peptide
  XENP019216 vlCDR2
GAFSRAT

SEQ ID NO: 2988 - protein, 9 aa, Artificial Sequence
  Description of Artificial Sequence: Synthetic peptide
  XENP019216 vlCDR3
QQYGSSPWT

SEQ ID NO: 2989 - protein, 221 aa, Artificial Sequence
  Description of Artificial Sequence: Synthetic polypeptide
  XENP019217 [CTLA-4]_H0.7_L0_Fab Heavy Chain
QVQLVESGGGVVEPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 2990 - protein, 118 aa, Artificial Sequence; identical to SEQ ID NO: 247
  Description of Artificial Sequence: Synthetic polypeptide
  VH of XENP019217

SEQ ID NO: 2991 - protein, 5 aa, Artificial Sequence
  Description of Artificial Sequence: Synthetic peptide
  XENP019217 vhCDR1
SYTMH

SEQ ID NO: 2992 - protein, 17 aa, Artificial Sequence
  Description of Artificial Sequence: Synthetic peptide
  XENP019217 vhCDR2
FISYDGNNKYYADSVKG

SEQ ID NO: 2993 - protein, 9 aa, Artificial Sequence
  Description of Artificial Sequence: Synthetic peptide
  XENP019217 vhCDR3
TGWLGPFDY

SEQ ID NO: 2994 - protein, 215 aa, Artificial Sequence; identical to SEQ ID NO: 2924
  Description of Artificial Sequence: Synthetic polypeptide
  XENP019217 [CTLA-4]_H0.7_L0_Fab Light Chain

SEQ ID NO: 2995 - protein, 108 aa, Artificial Sequence; identical to SEQ ID NO: 23
  Description of Artificial Sequence: Synthetic polypeptide
  VL of XENP019217

SEQ ID NO: 2996 - protein, 12 aa, Artificial Sequence
  Description of Artificial Sequence: Synthetic peptide
  XENP019217 vlCDR1
RASQSVGSSYLA

SEQ ID NO: 2997 - protein, 7 aa, Artificial Sequence
  Description of Artificial Sequence: Synthetic peptide
  XENP019217 vlCDR2
GAFSRAT

SEQ ID NO: 2998 - protein, 9 aa, Artificial Sequence
  Description of Artificial Sequence: Synthetic peptide
  XENP019217 vlCDR3
QQYGSSPWT

SEQ ID NO: 2999 - protein, 221 aa, Artificial Sequence
  Description of Artificial Sequence: Synthetic polypeptide
  XENP019218 [CTLA-4]_H0.8_L0_Fab Heavy Chain
QVQLVESGGGVVQPGGSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3000 - protein, 118 aa, Artificial Sequence; identical to SEQ ID NO: 256
  Description of Artificial Sequence: Synthetic polypeptide
  VH of XENP019218

SEQ ID NO: 3001 - protein, 5 aa, Artificial Sequence
  Description of Artificial Sequence: Synthetic peptide
  XENP019218 vhCDR1
SYTMH

SEQ ID NO: 3002 - protein, 17 aa, Artificial Sequence
  Description of Artificial Sequence: Synthetic peptide
  XENP019218 vhCDR2
FISYDGNNKYYADSVKG

SEQ ID NO: 3003 - protein, 9 aa, Artificial Sequence
  Description of Artificial Sequence: Synthetic peptide
  XENP019218 vhCDR3
TGWLGPFDY

SEQ ID NO: 3004 - protein, 215 aa, Artificial Sequence; identical to SEQ ID NO: 2924
  Description of Artificial Sequence: Synthetic polypeptide
  XENP019218 [CTLA-4]_H0.8_L0_Fab Light Chain

SEQ ID NO: 3005 - protein, 108 aa, Artificial Sequence; identical to SEQ ID NO: 23
  Description of Artificial Sequence: Synthetic polypeptide
  VL of XENP019218

SEQ ID NO: 3006 - protein, 12 aa, Artificial Sequence
  Description of Artificial Sequence: Synthetic peptide
  XENP019218 vlCDR1
RASQSVGSSYLA

SEQ ID NO: 3007 - protein, 7 aa, Artificial Sequence
  Description of Artificial Sequence: Synthetic peptide
  XENP019218 vlCDR2
GAFSRAT

SEQ ID NO: 3008 - protein, 9 aa, Artificial Sequence
  Description of Artificial Sequence: Synthetic peptide
  XENP019218 vlCDR3
QQYGSSPWT

SEQ ID NO: 3009 - protein, 221 aa, Artificial Sequence
  Description of Artificial Sequence: Synthetic polypeptide
  XENP019219 [CTLA-4]_H0.9_L0_Fab Heavy Chain
QVQLVESGGGVVQPGESLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3010 - protein, 118 aa, Artificial Sequence; identical to SEQ ID NO: 265
  Description of Artificial Sequence: Synthetic polypeptide
  VH of XENP019219

SEQ ID NO: 3011 - protein, 5 aa, Artificial Sequence
  Description of Artificial Sequence: Synthetic peptide
  XENP019219 vhCDR1
SYTMH

SEQ ID NO: 3012 - protein, 17 aa, Artificial Sequence
  Description of Artificial Sequence: Synthetic peptide
  XENP019219 vhCDR2
FISYDGNNKYYADSVKG

SEQ ID NO: 3013 - protein, 9 aa, Artificial Sequence
  Description of Artificial Sequence: Synthetic peptide
  XENP019219 vhCDR3
TGWLGPFDY

SEQ ID NO: 3014 - protein, 215 aa, Artificial Sequence; identical to SEQ ID NO: 2924
  Description of Artificial Sequence: Synthetic polypeptide
  XENP019219 [CTLA-4]_H0.9_L0_Fab Light Chain

SEQ ID NO: 3015 - protein, 108 aa, Artificial Sequence; identical to SEQ ID NO: 23
  Description of Artificial Sequence: Synthetic polypeptide
  VL of XENP019219

SEQ ID NO: 3016 - protein, 12 aa, Artificial Sequence
  Description of Artificial Sequence: Synthetic peptide
  XENP019219 vlCDR1
RASQSVGSSYLA

SEQ ID NO: 3017 - protein, 7 aa, Artificial Sequence
  Description of Artificial Sequence: Synthetic peptide
  XENP019219 vlCDR2
GAFSRAT

SEQ ID NO: 3018 - protein, 9 aa, Artificial Sequence
  Description of Artificial Sequence: Synthetic peptide
  XENP019219 vlCDR3
QQYGSSPWT

SEQ ID NO: 3019 - protein, 221 aa, Artificial Sequence
  Description of Artificial Sequence: Synthetic polypeptide
  XENP019220 [CTLA-4]_H0.10_L0_Fab Heavy Chain
QVQLVESGGGVVQPGRSLKLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3020 - protein, 118 aa, Artificial Sequence; identical to SEQ ID NO: 274
  Description of Artificial Sequence: Synthetic polypeptide
  VH of XENP019220

SEQ ID NO: 3021 - protein, 5 aa, Artificial Sequence
  Description of Artificial Sequence: Synthetic peptide
  XENP019220 vhCDR1
SYTMH

SEQ ID NO: 3022 - protein, 17 aa, Artificial Sequence
  Description of Artificial Sequence: Synthetic peptide
  XENP019220 vhCDR2
FISYDGNNKYYADSVKG

SEQ ID NO: 3023 - protein, 9 aa, Artificial Sequence
  Description of Artificial Sequence: Synthetic peptide
  XENP019220 vhCDR3
TGWLGPFDY

SEQ ID NO: 3024 - protein, 215 aa, Artificial Sequence; identical to SEQ ID NO: 2924
  Description of Artificial Sequence: Synthetic polypeptide
  XENP019220 [CTLA-4]_H0.10_L0_Fab Light Chain

SEQ ID NO: 3025 - protein, 108 aa, Artificial Sequence; identical to SEQ ID NO: 23
  Description of Artificial Sequence: Synthetic polypeptide
  VL of XENP019220

SEQ ID NO: 3026 - protein, 12 aa, Artificial Sequence
  Description of Artificial Sequence: Synthetic peptide
  XENP019220 vlCDR1
RASQSVGSSYLA

SEQ ID NO: 3027 - protein, 7 aa, Artificial Sequence
  Description of Artificial Sequence: Synthetic peptide
  XENP019220 vlCDR2
GAFSRAT

SEQ ID NO: 3028 - protein, 9 aa, Artificial Sequence
  Description of Artificial Sequence: Synthetic peptide
  XENP019220 vlCDR3
QQYGSSPWT

SEQ ID NO: 3029 - protein, 221 aa, Artificial Sequence
  Description of Artificial Sequence: Synthetic polypeptide
  XENP019221 [CTLA-4]_H0.11_L0_Fab Heavy Chain
QVQLVESGGGVVQPGRSLRLSCAASGFTVSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3030 - protein, 118 aa, Artificial Sequence; identical to SEQ ID NO: 283
  Description of Artificial Sequence: Synthetic polypeptide
  VH of XENP019221

SEQ ID NO: 3031 - protein, 5 aa, Artificial Sequence
  Description of Artificial Sequence: Synthetic peptide
  XENP019221 vhCDR1
SYTMH

SEQ ID NO: 3032 - protein, 17 aa, Artificial Sequence
  Description of Artificial Sequence: Synthetic peptide
  XENP019221 vhCDR2
FISYDGNNKYYADSVKG

SEQ ID NO: 3033 - protein, 9 aa, Artificial Sequence
  Description of Artificial Sequence: Synthetic peptide
  XENP019221 vhCDR3
TGWLGPFDY

SEQ ID NO: 3034 - protein, 215 aa, Artificial Sequence; identical to SEQ ID NO: 2924
  Description of Artificial Sequence: Synthetic polypeptide
  XENP019221 [CTLA-4]_H0.11_L0_Fab Light Chain

SEQ ID NO: 3035 - protein, 108 aa, Artificial Sequence; identical to SEQ ID NO: 23
  Description of Artificial Sequence: Synthetic polypeptide
  VL of XENP019221

SEQ ID NO: 3036 - protein, 12 aa, Artificial Sequence
  Description of Artificial Sequence: Synthetic peptide
  XENP019221 vlCDR1
RASQSVGSSYLA

SEQ ID NO: 3037 - protein, 7 aa, Artificial Sequence
  Description of Artificial Sequence: Synthetic peptide
  XENP019221 vlCDR2
GAFSRAT

SEQ ID NO: 3038 - protein, 9 aa, Artificial Sequence
  Description of Artificial Sequence: Synthetic peptide
  XENP019221 vlCDR3
QQYGSSPWT

SEQ ID NO: 3039 - protein, 221 aa, Artificial Sequence
  Description of Artificial Sequence: Synthetic polypeptide
  XENP019222 [CTLA-4]_H0.12_L0_Fab Heavy Chain
QVQLVESGGGVVQPGRSLRLSCAASGFTFSAYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3040 - protein, 118 aa, Artificial Sequence; identical to SEQ ID NO: 292
  Description of Artificial Sequence: Synthetic polypeptide
  VH of XENP019222

SEQ ID NO: 3041 - protein, 5 aa, Artificial Sequence
  Description of Artificial Sequence: Synthetic peptide
  XENP019222 vhCDR1
AYTMH

SEQ ID NO: 3042 - protein, 17 aa, Artificial Sequence
  Description of Artificial Sequence: Synthetic peptide
  XENP019222 vhCDR2
FISYDGNNKYYADSVKG

SEQ ID NO: 3043 - protein, 9 aa, Artificial Sequence
  Description of Artificial Sequence: Synthetic peptide
  XENP019222 vhCDR3
TGWLGPFDY

SEQ ID NO: 3044 - protein, 215 aa, Artificial Sequence; identical to SEQ ID NO: 2924
  Description of Artificial Sequence: Synthetic polypeptide
  XENP019222 [CTLA-4]_H0.12_L0_Fab Light Chain

SEQ ID NO: 3045 - protein, 108 aa, Artificial Sequence; identical to SEQ ID NO: 23
  Description of Artificial Sequence: Synthetic polypeptide
  VL of XENP019222

SEQ ID NO: 3046 - protein, 12 aa, Artificial Sequence
  Description of Artificial Sequence: Synthetic peptide
  XENP019222 vlCDR1
RASQSVGSSYLA

SEQ ID NO: 3047 - protein, 7 aa, Artificial Sequence
  Description of Artificial Sequence: Synthetic peptide
  XENP019222 vlCDR2
GAFSRAT

SEQ ID NO: 3048 - protein, 9 aa, Artificial Sequence
  Description of Artificial Sequence: Synthetic peptide
  XENP019222 vlCDR3
QQYGSSPWT

SEQ ID NO: 3049 - protein, 221 aa, Artificial Sequence
  Description of Artificial Sequence: Synthetic polypeptide
  XENP019223 [CTLA-4]_H0.13_L0_Fab Heavy Chain
QVQLVESGGGVVQPGRSLRLSCAASGFTFSDYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3050 - protein, 118 aa, Artificial Sequence; identical to SEQ ID NO: 301
  Description of Artificial Sequence: Synthetic polypeptide
  VH of XENP019223

SEQ ID NO: 3051 - protein, 5 aa, Artificial Sequence
  Description of Artificial Sequence: Synthetic peptide
  XENP019223 vhCDR1
DYTMH

SEQ ID NO: 3052 - protein, 17 aa, Artificial Sequence
  Description of Artificial Sequence: Synthetic peptide
  XENP019223 vhCDR2
FISYDGNNKYYADSVKG

SEQ ID NO: 3053 - protein, 9 aa, Artificial Sequence
  Description of Artificial Sequence: Synthetic peptide
  XENP019223 vhCDR3
TGWLGPFDY

SEQ ID NO: 3054 - protein, 215 aa, Artificial Sequence; identical to SEQ ID NO: 2924
  Description of Artificial Sequence: Synthetic polypeptide
  XENP019223 [CTLA-4]_H0.13_L0_Fab Light Chain

SEQ ID NO: 3055 - protein, 108 aa, Artificial Sequence; identical to SEQ ID NO: 23
  Description of Artificial Sequence: Synthetic polypeptide
  VL of XENP019223

SEQ ID NO: 3056 - protein, 12 aa, Artificial Sequence
  Description of Artificial Sequence: Synthetic peptide
  XENP019223 vlCDR1
RASQSVGSSYLA

SEQ ID NO: 3057 - protein, 7 aa, Artificial Sequence
  Description of Artificial Sequence: Synthetic peptide
  XENP019223 vlCDR2
GAFSRAT

SEQ ID NO: 3058 - protein, 9 aa, Artificial Sequence
  Description of Artificial Sequence: Synthetic peptide
  XENP019223 vlCDR3
QQYGSSPWT

SEQ ID NO: 3059 - protein, 221 aa, Artificial Sequence
  Description of Artificial Sequence: Synthetic polypeptide
  XENP019224 [CTLA-4]_H0.14_L0_Fab Heavy Chain
QVQLVESGGGVVQPGRSLRLSCAASGFTFSGYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3060 - protein, 118 aa, Artificial Sequence; identical to SEQ ID NO: 310
  Description of Artificial Sequence: Synthetic polypeptide
  VH of XENP019224

SEQ ID NO: 3061 - protein, 5 aa, Artificial Sequence
  Description of Artificial Sequence: Synthetic peptide
  XENP019224 vhCDR1
GYTMH

SEQ ID NO: 3062 - protein, 17 aa, Artificial Sequence
  Description of Artificial Sequence: Synthetic peptide
  XENP019224 vhCDR2
FISYDGNNKYYADSVKG

SEQ ID NO: 3063 - protein, 9 aa, Artificial Sequence
  Description of Artificial Sequence: Synthetic peptide
  XENP019224 vhCDR3
TGWLGPFDY

SEQ ID NO: 3064 - protein, 215 aa, Artificial Sequence; identical to SEQ ID NO: 2924
  Description of Artificial Sequence: Synthetic polypeptide
  XENP019224 [CTLA-4]_H0.14_L0_Fab Light Chain

SEQ ID NO: 3065 - protein, 108 aa, Artificial Sequence; identical to SEQ ID NO: 23
  Description of Artificial Sequence: Synthetic polypeptide
  VL of XENP019224

SEQ ID NO: 3066 - protein, 12 aa, Artificial Sequence
  Description of Artificial Sequence: Synthetic peptide
  XENP019224 vlCDR1
RASQSVGSSYLA

SEQ ID NO: 3067 - protein, 7 aa, Artificial Sequence
  Description of Artificial Sequence: Synthetic peptide
  XENP019224 vlCDR2
GAFSRAT

SEQ ID NO: 3068 - protein, 9 aa, Artificial Sequence
  Description of Artificial Sequence: Synthetic peptide
  XENP019224 vlCDR3
QQYGSSPWT

SEQ ID NO: 3069 - protein, 221 aa, Artificial Sequence
  Description of Artificial Sequence: Synthetic polypeptide
  XENP019225 [CTLA-4]_H0.15_L0_Fab Heavy Chain
QVQLVESGGGVVQPGRSLRLSCAASGFTFSNYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3070 - protein, 118 aa, Artificial Sequence; identical to SEQ ID NO: 319
  Description of Artificial Sequence: Synthetic polypeptide
  VH of XENP019225

SEQ ID NO: 3071 - protein, 5 aa, Artificial Sequence
  Description of Artificial Sequence: Synthetic peptide
  XENP019225 vhCDR1
NYTMH

SEQ ID NO: 3072 - protein, 17 aa, Artificial Sequence
  Description of Artificial Sequence: Synthetic peptide
  XENP019225 vhCDR2
FISYDGNNKYYADSVKG

SEQ ID NO: 3073 - protein, 9 aa, Artificial Sequence
  Description of Artificial Sequence: Synthetic peptide
  XENP019225 vhCDR3
TGWLGPFDY

SEQ ID NO: 3074 - protein, 215 aa, Artificial Sequence; identical to SEQ ID NO: 2924
  Description of Artificial Sequence: Synthetic polypeptide
  XENP019225 [CTLA-4]_H0.15_L0_Fab Light Chain

SEQ ID NO: 3075 - protein, 108 aa, Artificial Sequence; identical to SEQ ID NO: 23
  Description of Artificial Sequence: Synthetic polypeptide
  VL of XENP019225

SEQ ID NO: 3076 - protein, 12 aa, Artificial Sequence
  Description of Artificial Sequence: Synthetic peptide
  XENP019225 vlCDR1
RASQSVGSSYLA

SEQ ID NO: 3077 - protein, 7 aa, Artificial Sequence
  Description of Artificial Sequence: Synthetic peptide
  XENP019225 vlCDR2
GAFSRAT

SEQ ID NO: 3078 - protein, 9 aa, Artificial Sequence
  Description of Artificial Sequence: Synthetic peptide
  XENP019225 vlCDR3
QQYGSSPWT

SEQ ID NO: 3079 - protein, 221 aa, Artificial Sequence
  Description of Artificial Sequence: Synthetic polypeptide
  XENP019226 [CTLA-4]_H0.16_L0_Fab Heavy Chain
QVQLVESGGGVVQPGRSLRLSCAASGFTFSQYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3080 - protein, 118 aa, Artificial Sequence; identical to SEQ ID NO: 328
  Description of Artificial Sequence: Synthetic polypeptide
  VH of XENP019226

SEQ ID NO: 3081 - protein, 5 aa, Artificial Sequence
  Description of Artificial Sequence: Synthetic peptide
  XENP019226 vhCDR1
QYTMH

SEQ ID NO: 3082 - protein, 17 aa, Artificial Sequence
  Description of Artificial Sequence: Synthetic peptide
  XENP019226 vhCDR2
FISYDGNNKYYADSVKG

SEQ ID NO: 3083 - protein, 9 aa, Artificial Sequence
  Description of Artificial Sequence: Synthetic peptide
  XENP019226 vhCDR3
TGWLGPFDY

SEQ ID NO: 3084 - protein, 215 aa, Artificial Sequence; identical to SEQ ID NO: 2924
  Description of Artificial Sequence: Synthetic polypeptide
  XENP019226 [CTLA-4]_H0.16_L0_Fab Light Chain

SEQ ID NO: 3085 - protein, 108 aa, Artificial Sequence; identical to SEQ ID NO: 23
  Description of Artificial Sequence: Synthetic polypeptide
  VL of XENP019226

SEQ ID NO: 3086 - protein, 12 aa, Artificial Sequence
  Description of Artificial Sequence: Synthetic peptide
  XENP019226 vlCDR1
RASQSVGSSYLA

SEQ ID NO: 3087 - protein, 7 aa, Artificial Sequence
  Description of Artificial Sequence: Synthetic peptide
  XENP019226 vlCDR2
GAFSRAT

SEQ ID NO: 3088 - protein, 9 aa, Artificial Sequence
  Description of Artificial Sequence: Synthetic peptide
  XENP019226 vlCDR3
QQYGSSPWT

SEQ ID NO: 3089 - protein, 221 aa, Artificial Sequence
  Description of Artificial Sequence: Synthetic polypeptide
  XENP019227 [CTLA-4]_H0.17_L0_Fab Heavy Chain
QVQLVESGGGVVQPGRSLRLSCAASGFTFSTYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3090 - protein, 118 aa, Artificial Sequence; identical to SEQ ID NO: 337
  Description of Artificial Sequence: Synthetic polypeptide
  VH of XENP019227

SEQ ID NO: 3091 - protein, 5 aa, Artificial Sequence
  Description of Artificial Sequence: Synthetic peptide
  XENP019227 vhCDR1
TYTMH

SEQ ID NO: 3092 - protein, 17 aa, Artificial Sequence
  Description of Artificial Sequence: Synthetic peptide
  XENP019227 vhCDR2
FISYDGNNKYYADSVKG

SEQ ID NO: 3093 - protein, 9 aa, Artificial Sequence
  Description of Artificial Sequence: Synthetic peptide
  XENP019227 vhCDR3
TGWLGPFDY

SEQ ID NO: 3094 - protein, 215 aa, Artificial Sequence; identical to SEQ ID NO: 2924
  Description of Artificial Sequence: Synthetic polypeptide
  XENP019227 [CTLA-4]_H0.17_L0_Fab Light Chain

SEQ ID NO: 3095 - protein, 108 aa, Artificial Sequence; identical to SEQ ID NO: 23
  Description of Artificial Sequence: Synthetic polypeptide
  VL of XENP019227

SEQ ID NO: 3096 - protein, 12 aa, Artificial Sequence
  Description of Artificial Sequence: Synthetic peptide
  XENP019227 vlCDR1
RASQSVGSSYLA

SEQ ID NO: 3097 - protein, 7 aa, Artificial Sequence
  Description of Artificial Sequence: Synthetic peptide
  XENP019227 vlCDR2
GAFSRAT

SEQ ID NO: 3098 - protein, 9 aa, Artificial Sequence
  Description of Artificial Sequence: Synthetic peptide
  XENP019227 vlCDR3
QQYGSSPWT

SEQ ID NO: 3099 - protein, 221 aa, Artificial Sequence
  Description of Artificial Sequence: Synthetic polypeptide
  XENP019228 [CTLA-4]_H0.18_L0_Fab Heavy Chain
QVQLVESGGGVVQPGRSLRLSCAASGFTFSSATMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3100 - protein, 118 aa, Artificial Sequence; identical to SEQ ID NO: 346
  Description of Artificial Sequence: Synthetic polypeptide
  VH of XENP019228

SEQ ID NO: 3101 - protein, 5 aa, Artificial Sequence
  Description of Artificial Sequence: Synthetic peptide
  XENP019228 vhCDR1
SATMH

SEQ ID NO: 3102 - protein, 17 aa, Artificial Sequence
  Description of Artificial Sequence: Synthetic peptide
  XENP019228 vhCDR2
FISYDGNNKYYADSVKG

SEQ ID NO: 3103 - protein, 9 aa, Artificial Sequence
  Description of Artificial Sequence: Synthetic peptide
  XENP019228 vhCDR3
TGWLGPFDY

SEQ ID NO: 3104 - protein, 215 aa, Artificial Sequence; identical to SEQ ID NO: 2924
  Description of Artificial Sequence: Synthetic polypeptide
  XENP019228 [CTLA-4]_H0.18_L0_Fab Light Chain

SEQ ID NO: 3105 - protein, 108 aa, Artificial Sequence; identical to SEQ ID NO: 23
  Description of Artificial Sequence: Synthetic polypeptide
  VL of XENP019228

SEQ ID NO: 3106 - protein, 12 aa, Artificial Sequence
  Description of Artificial Sequence: Synthetic peptide
  XENP019228 vlCDR1
RASQSVGSSYLA

SEQ ID NO: 3107 - protein, 7 aa, Artificial Sequence
  Description of Artificial Sequence: Synthetic peptide
  XENP019228 vlCDR2
GAFSRAT

SEQ ID NO: 3108 - protein, 9 aa, Artificial Sequence
  Description of Artificial Sequence: Synthetic peptide
  XENP019228 vlCDR3
QQYGSSPWT

SEQ ID NO: 3109 - protein, 221 aa, Artificial Sequence
  Description of Artificial Sequence: Synthetic polypeptide
  XENP019229 [CTLA-4]_H0.19_L0_Fab Heavy Chain
QVQLVESGGGVVQPGRSLRLSCAASGFTFSSHTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3110 - protein, 118 aa, Artificial Sequence; identical to SEQ ID NO: 355
  Description of Artificial Sequence: Synthetic polypeptide
  VH of XENP019229

SEQ ID NO: 3111 - protein, 5 aa, Artificial Sequence
  Description of Artificial Sequence: Synthetic peptide
  XENP019229 vhCDR1
SHTMH

SEQ ID NO: 3112 - protein, 17 aa, Artificial Sequence
  Description of Artificial Sequence: Synthetic peptide
  XENP019229 vhCDR2
FISYDGNNKYYADSVKG

SEQ ID NO: 3113 - protein, 9 aa, Artificial Sequence
  Description of Artificial Sequence: Synthetic peptide
  XENP019229 vhCDR3
TGWLGPFDY

SEQ ID NO: 3114 - protein, 215 aa, Artificial Sequence; identical to SEQ ID NO: 2924
  Description of Artificial Sequence: Synthetic polypeptide
  XENP019229 [CTLA-4]_H0.19_L0_Fab Light Chain

SEQ ID NO: 3115 - protein, 108 aa, Artificial Sequence; identical to SEQ ID NO: 23
  Description of Artificial Sequence: Synthetic polypeptide
  VL of XENP019229

SEQ ID NO: 3116 - protein, 12 aa, Artificial Sequence
  Description of Artificial Sequence: Synthetic peptide
  XENP019229 vlCDR1
RASQSVGSSYLA

SEQ ID NO: 3117 - protein, 7 aa, Artificial Sequence
  Description of Artificial Sequence: Synthetic peptide
  XENP019229 vlCDR2
GAFSRAT

SEQ ID NO: 3118 - protein, 9 aa, Artificial Sequence
  Description of Artificial Sequence: Synthetic peptide
  XENP019229 vlCDR3
QQYGSSPWT

SEQ ID NO: 3119 - protein, 221 aa, Artificial Sequence
  Description of Artificial Sequence: Synthetic polypeptide
  XENP019230 [CTLA-4]_H0.20_L0_Fab Heavy Chain
QVQLVESGGGVVQPGRSLRLSCAASGFTFSSFTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3120 - protein, 118 aa, Artificial Sequence; identical to SEQ ID NO: 364
  Description of Artificial Sequence: Synthetic polypeptide
  VH of XENP019230

SEQ ID NO: 3121 - protein, 5 aa, Artificial Sequence
  Description of Artificial Sequence: Synthetic peptide
  XENP019230 vhCDR1
SFTMH

SEQ ID NO: 3122 - protein, 17 aa, Artificial Sequence
  Description of Artificial Sequence: Synthetic peptide
  XENP019230 vhCDR2
FISYDGNNKYYADSVKG

SEQ ID NO: 3123 - protein, 9 aa, Artificial Sequence
  Description of Artificial Sequence: Synthetic peptide
  XENP019230 vhCDR3
TGWLGPFDY

SEQ ID NO: 3124 - protein, 215 aa, Artificial Sequence; identical to SEQ ID NO: 2924
  Description of Artificial Sequence: Synthetic polypeptide
  XENP019230 [CTLA-4]_H0.20_L0_Fab Light Chain

SEQ ID NO: 3125 - protein, 108 aa, Artificial Sequence; identical to SEQ ID NO: 23
  Description of Artificial Sequence: Synthetic polypeptide
  VL of XENP019230

SEQ ID NO: 3126 - protein, 12 aa, Artificial Sequence
  Description of Artificial Sequence: Synthetic peptide
  XENP019230 vlCDR1
RASQSVGSSYLA

SEQ ID NO: 3127 - protein, 7 aa, Artificial Sequence
  Description of Artificial Sequence: Synthetic peptide
  XENP019230 vlCDR2
GAFSRAT

SEQ ID NO: 3128 - protein, 9 aa, Artificial Sequence
  Description of Artificial Sequence: Synthetic peptide
  XENP019230 vlCDR3
QQYGSSPWT

SEQ ID NO: 3129 - protein, 221 aa, Artificial Sequence
  Description of Artificial Sequence: Synthetic polypeptide
  XENP019231 [CTLA-4]_H0.21_L0_Fab Heavy Chain
QVQLVESGGGVVQPGRSLRLSCAASGFTFSSLTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3130 - protein, 118 aa, Artificial Sequence; identical to SEQ ID NO: 373
  Description of Artificial Sequence: Synthetic polypeptide
  VH of XENP019231

SEQ ID NO: 3131 - protein, 5 aa, Artificial Sequence
  Description of Artificial Sequence: Synthetic peptide
  XENP019231 vhCDR1
SLTMH

SEQ ID NO: 3132 - protein, 17 aa, Artificial Sequence
  Description of Artificial Sequence: Synthetic peptide
  XENP019231 vhCDR2
FISYDGNNKYYADSVKG

SEQ ID NO: 3133 - protein, 9 aa, Artificial Sequence
  Description of Artificial Sequence: Synthetic peptide
  XENP019231 vhCDR3
TGWLGPFDY

SEQ ID NO: 3134 - protein, 215 aa, Artificial Sequence; identical to SEQ ID NO: 2924
  Description of Artificial Sequence: Synthetic polypeptide
  XENP019231 [CTLA-4]_H0.21_L0_Fab Light Chain

SEQ ID NO: 3135 - protein, 108 aa, Artificial Sequence; identical to SEQ ID NO: 23
  Description of Artificial Sequence: Synthetic polypeptide
  VL of XENP019231

SEQ ID NO: 3136 - protein, 12 aa, Artificial Sequence
  Description of Artificial Sequence: Synthetic peptide
  XENP019231 vlCDR1
RASQSVGSSYLA

SEQ ID NO: 3137 - protein, 7 aa, Artificial Sequence
  Description of Artificial Sequence: Synthetic peptide
  XENP019231 vlCDR2
GAFSRAT

SEQ ID NO: 3138 - protein, 9 aa, Artificial Sequence
  Description of Artificial Sequence: Synthetic peptide
  XENP019231 vlCDR3
QQYGSSPWT

SEQ ID NO: 3139 - protein, 221 aa, Artificial Sequence
  Description of Artificial Sequence: Synthetic polypeptide
  XENP019232 [CTLA-4]_H0.22_L0_Fab Heavy Chain
QVQLVESGGGVVQPGRSLRLSCAASGFTFSSNTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3140 - protein, 118 aa, Artificial Sequence; identical to SEQ ID NO: 382
  Description of Artificial Sequence: Synthetic polypeptide
  VH of XENP019232

SEQ ID NO: 3141 - protein, 5 aa, Artificial Sequence
  Description of Artificial Sequence: Synthetic peptide
  XENP019232 vhCDR1
SNTMH

SEQ ID NO: 3142 - protein, 17 aa, Artificial Sequence
  Description of Artificial Sequence: Synthetic peptide
  XENP019232 vhCDR2
FISYDGNNKYYADSVKG

SEQ ID NO: 3143 - protein, 9 aa, Artificial Sequence
  Description of Artificial Sequence: Synthetic peptide
  XENP019232 vhCDR3
TGWLGPFDY

SEQ ID NO: 3144 - protein, 215 aa, Artificial Sequence; identical to SEQ ID NO: 2924
  Description of Artificial Sequence: Synthetic polypeptide
  XENP019232 [CTLA-4]_H0.22_L0_Fab Light Chain

SEQ ID NO: 3145 - protein, 108 aa, Artificial Sequence; identical to SEQ ID NO: 23
  Description of Artificial Sequence: Synthetic polypeptide
  VL of XENP019232

SEQ ID NO: 3146 - protein, 12 aa, Artificial Sequence
  Description of Artificial Sequence: Synthetic peptide
  XENP019232 vlCDR1
RASQSVGSSYLA

SEQ ID NO: 3147 - protein, 7 aa, Artificial Sequence
  Description of Artificial Sequence: Synthetic peptide
  XENP019232 vlCDR2
GAFSRAT

SEQ ID NO: 3148 - protein, 9 aa, Artificial Sequence
  Description of Artificial Sequence: Synthetic peptide
  XENP019232 vlCDR3
QQYGSSPWT

SEQ ID NO: 3149 - protein, 221 aa, Artificial Sequence
  Description of Artificial Sequence: Synthetic polypeptide
  XENP019233 [CTLA-4]_H0.23_L0_Fab Heavy Chain
QVQLVESGGGVVQPGRSLRLSCAASGFTFSSSTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3150 - protein, 118 aa, Artificial Sequence; identical to SEQ ID NO: 391
  Description of Artificial Sequence: Synthetic polypeptide
  VH of XENP019233

SEQ ID NO: 3151 - protein, 5 aa, Artificial Sequence
  Description of Artificial Sequence: Synthetic peptide
  XENP019233 vhCDR1
SSTMH

SEQ ID NO: 3152 - protein, 17 aa, Artificial Sequence
  Description of Artificial Sequence: Synthetic peptide
  XENP019233 vhCDR2
FISYDGNNKYYADSVKG

SEQ ID NO: 3153 - protein, 9 aa, Artificial Sequence
  Description of Artificial Sequence: Synthetic peptide
  XENP019233 vhCDR3
TGWLGPFDY

SEQ ID NO: 3154 - protein, 215 aa, Artificial Sequence; identical to SEQ ID NO: 2924
  Description of Artificial Sequence: Synthetic polypeptide
  XENP019233 [CTLA-4]_H0.23_L0_Fab Light Chain

SEQ ID NO: 3155 - protein, 108 aa, Artificial Sequence; identical to SEQ ID NO: 23
  Description of Artificial Sequence: Synthetic polypeptide
  VL of XENP019233

SEQ ID NO: 3156 - protein, 12 aa, Artificial Sequence
  Description of Artificial Sequence: Synthetic peptide
  XENP019233 vlCDR1
RASQSVGSSYLA

SEQ ID NO: 3157 - protein, 7 aa, Artificial Sequence
  Description of Artificial Sequence: Synthetic peptide
  XENP019233 vlCDR2
GAFSRAT

SEQ ID NO: 3158 - protein, 9 aa, Artificial Sequence
  Description of Artificial Sequence: Synthetic peptide
  XENP019233 vlCDR3
QQYGSSPWT

SEQ ID NO: 3159 - protein, 221 aa, Artificial Sequence
  Description of Artificial Sequence: Synthetic polypeptide
  XENP019234 [CTLA-4]_H0.24_L0_Fab Heavy Chain
QVQLVESGGGVVQPGRSLRLSCAASGFTFSSVTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3160 - protein, 118 aa, Artificial Sequence; identical to SEQ ID NO: 400
  Description of Artificial Sequence: Synthetic polypeptide
  VH of XENP019234

SEQ ID NO: 3161 - protein, 5 aa, Artificial Sequence
  Description of Artificial Sequence: Synthetic peptide
  XENP019234 vhCDR1
SVTMH

SEQ ID NO: 3162 - protein, 17 aa, Artificial Sequence
  Description of Artificial Sequence: Synthetic peptide
  XENP019234 vhCDR2
FISYDGNNKYYADSVKG

SEQ ID NO: 3163 - protein, 9 aa, Artificial Sequence
  Description of Artificial Sequence: Synthetic peptide
  XENP019234 vhCDR3
TGWLGPFDY

SEQ ID NO: 3164 - protein, 215 aa, Artificial Sequence; identical to SEQ ID NO: 2924
  Description of Artificial Sequence: Synthetic polypeptide
  XENP019234 [CTLA-4]_H0.24_L0_Fab Light Chain

SEQ ID NO: 3165 - protein, 108 aa, Artificial Sequence; identical to SEQ ID NO: 23
  Description of Artificial Sequence: Synthetic polypeptide
  VL of XENP019234

SEQ ID NO: 3166 - protein, 12 aa, Artificial Sequence
  Description of Artificial Sequence: Synthetic peptide
  XENP019234 vlCDR1
RASQSVGSSYLA

SEQ ID NO: 3167 - protein, 7 aa, Artificial Sequence
  Description of Artificial Sequence: Synthetic peptide
  XENP019234 vlCDR2
GAFSRAT

SEQ ID NO: 3168 - protein, 9 aa, Artificial Sequence
  Description of Artificial Sequence: Synthetic peptide
  XENP019234 vlCDR3
QQYGSSPWT

SEQ ID NO: 3169 - protein, 221 aa, Artificial Sequence
  Description of Artificial Sequence: Synthetic polypeptide
  XENP019235 [CTLA-4]_H0.25_L0_Fab Heavy Chain
QVQLVESGGGVVQPGRSLRLSCAASGFTFSSYAMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3170 - protein, 118 aa, Artificial Sequence; identical to SEQ ID NO: 409
  Description of Artificial Sequence: Synthetic polypeptide
  VH of XENP019235

SEQ ID NO: 3171 - protein, 5 aa, Artificial Sequence
  Description of Artificial Sequence: Synthetic peptide
  XENP019235 vhCDR1
SYAMH

SEQ ID NO: 3172 - protein, 17 aa, Artificial Sequence
  Description of Artificial Sequence: Synthetic peptide
  XENP019235 vhCDR2
FISYDGNNKYYADSVKG

SEQ ID NO: 3173 - protein, 9 aa, Artificial Sequence
  Description of Artificial Sequence: Synthetic peptide
  XENP019235 vhCDR3
TGWLGPFDY

SEQ ID NO: 3174 - protein, 215 aa, Artificial Sequence; identical to SEQ ID NO: 2924
  Description of Artificial Sequence: Synthetic polypeptide
  XENP019235 [CTLA-4]_H0.25_L0_Fab Light Chain

SEQ ID NO: 3175 - protein, 108 aa, Artificial Sequence; identical to SEQ ID NO: 23
  Description of Artificial Sequence: Synthetic polypeptide
  VL of XENP019235

SEQ ID NO: 3176 - protein, 12 aa, Artificial Sequence
  Description of Artificial Sequence: Synthetic peptide
  XENP019235 vlCDR1
RASQSVGSSYLA

SEQ ID NO: 3177 - protein, 7 aa, Artificial Sequence
  Description of Artificial Sequence: Synthetic peptide
  XENP019235 vlCDR2
GAFSRAT

SEQ ID NO: 3178 - protein, 9 aa, Artificial Sequence
  Description of Artificial Sequence: Synthetic peptide
  XENP019235 vlCDR3
QQYGSSPWT

SEQ ID NO: 3179 - protein, 221 aa, Artificial Sequence
  Description of Artificial Sequence: Synthetic polypeptide
  XENP019236 [CTLA-4]_H0.26_L0_Fab Heavy Chain
QVQLVESGGGVVQPGRSLRLSCAASGFTFSSYGMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3180 - protein, 118 aa, Artificial Sequence; identical to SEQ ID NO: 418
  Description of Artificial Sequence: Synthetic polypeptide
  VH of XENP019236

SEQ ID NO: 3181 - protein, 5 aa, Artificial Sequence
  Description of Artificial Sequence: Synthetic peptide
  XENP019236 vhCDR1
SYGMH

SEQ ID NO: 3182 - protein, 17 aa, Artificial Sequence
  Description of Artificial Sequence: Synthetic peptide
  XENP019236 vhCDR2
FISYDGNNKYYADSVKG

SEQ ID NO: 3183 - protein, 9 aa, Artificial Sequence
  Description of Artificial Sequence: Synthetic peptide
  XENP019236 vhCDR3
TGWLGPFDY

SEQ ID NO: 3184 - protein, 215 aa, Artificial Sequence; identical to SEQ ID NO: 2924
  Description of Artificial Sequence: Synthetic polypeptide
  XENP019236 [CTLA-4]_H0.26_L0_Fab Light Chain

SEQ ID NO: 3185 - protein, 108 aa, Artificial Sequence; identical to SEQ ID NO: 23
  Description of Artificial Sequence: Synthetic polypeptide
  VL of XENP019236

SEQ ID NO: 3186 - protein, 12 aa, Artificial Sequence
  Description of Artificial Sequence: Synthetic peptide
  XENP019236 vlCDR1
RASQSVGSSYLA

SEQ ID NO: 3187 - protein, 7 aa, Artificial Sequence
  Description of Artificial Sequence: Synthetic peptide
  XENP019236 vlCDR2
GAFSRAT

SEQ ID NO: 3188 - protein, 9 aa, Artificial Sequence
  Description of Artificial Sequence: Synthetic peptide
  XENP019236 vlCDR3
QQYGSSPWT

SEQ ID NO: 3189 - protein, 221 aa, Artificial Sequence
  Description of Artificial Sequence: Synthetic polypeptide
  XENP019237 [CTLA-4]_H0.27_L0_Fab Heavy Chain
QVQLVESGGGVVQPGRSLRLSCAASGFTFSSYSMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3190 - protein, 118 aa, Artificial Sequence; identical to SEQ ID NO: 427
  Description of Artificial Sequence: Synthetic polypeptide
  VH of XENP019237

SEQ ID NO: 3191 - protein, 5 aa, Artificial Sequence
  Description of Artificial Sequence: Synthetic peptide
  XENP019237 vhCDR1
SYSMH

SEQ ID NO: 3192 - protein, 17 aa, Artificial Sequence
  Description of Artificial Sequence: Synthetic peptide
  XENP019237 vhCDR2
FISYDGNNKYYADSVKG

SEQ ID NO: 3193 - protein, 9 aa, Artificial Sequence
  Description of Artificial Sequence: Synthetic peptide
  XENP019237 vhCDR3
TGWLGPFDY

SEQ ID NO: 3194 - protein, 215 aa, Artificial Sequence; identical to SEQ ID NO: 2924
  Description of Artificial Sequence: Synthetic polypeptide
  XENP019237 [CTLA-4]_H0.27_L0_Fab Light Chain

SEQ ID NO: 3195 - protein, 108 aa, Artificial Sequence; identical to SEQ ID NO: 23
  Description of Artificial Sequence: Synthetic polypeptide
  VL of XENP019237

SEQ ID NO: 3196 - protein, 12 aa, Artificial Sequence
  Description of Artificial Sequence: Synthetic peptide
  XENP019237 vlCDR1
RASQSVGSSYLA

SEQ ID NO: 3197 - protein, 7 aa, Artificial Sequence
  Description of Artificial Sequence: Synthetic peptide
  XENP019237 vlCDR2
GAFSRAT

SEQ ID NO: 3198 - protein, 9 aa, Artificial Sequence
  Description of Artificial Sequence: Synthetic peptide
  XENP019237 vlCDR3
QQYGSSPWT

SEQ ID NO: 3199 - protein, 221 aa, Artificial Sequence
  Description of Artificial Sequence: Synthetic polypeptide
  XENP019238 [CTLA-4]_H0.28_L0_Fab Heavy Chain
QVQLVESGGGVVQPGRSLRLSCAASGFTFSSYVMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3200 - protein, 118 aa, Artificial Sequence; identical to SEQ ID NO: 436
  Description of Artificial Sequence: Synthetic polypeptide
  VH of XENP019238

SEQ ID NO: 3201 - protein, 5 aa, Artificial Sequence
  Description of Artificial Sequence: Synthetic peptide
  XENP019238 vhCDR1
SYVMH

SEQ ID NO: 3202 - protein, 17 aa, Artificial Sequence
  Description of Artificial Sequence: Synthetic peptide
  XENP019238 vhCDR2
FISYDGNNKYYADSVKG

SEQ ID NO: 3203 - protein, 9 aa, Artificial Sequence
  Description of Artificial Sequence: Synthetic peptide
  XENP019238 vhCDR3
TGWLGPFDY

SEQ ID NO: 3204 - protein, 215 aa, Artificial Sequence; identical to SEQ ID NO: 2924
  Description of Artificial Sequence: Synthetic polypeptide
  XENP019238 [CTLA-4]_H0.28_L0_Fab Light Chain

SEQ ID NO: 3205 - protein, 108 aa, Artificial Sequence; identical to SEQ ID NO: 23
  Description of Artificial Sequence: Synthetic polypeptide
  VL of XENP019238

SEQ ID NO: 3206 - protein, 12 aa, Artificial Sequence
  Description of Artificial Sequence: Synthetic peptide
  XENP019238 vlCDR1
RASQSVGSSYLA

SEQ ID NO: 3207 - protein, 7 aa, Artificial Sequence
  Description of Artificial Sequence: Synthetic peptide
  XENP019238 vlCDR2
GAFSRAT

SEQ ID NO: 3208 - protein, 9 aa, Artificial Sequence
  Description of Artificial Sequence: Synthetic peptide
  XENP019238 vlCDR3
QQYGSSPWT

SEQ ID NO: 3209 - protein, 221 aa, Artificial Sequence
  Description of Artificial Sequence: Synthetic polypeptide
  XENP019239 [CTLA-4]_H0.29_L0_Fab Heavy Chain
QVQLVESGGGVVQPGRSLRLSCAASGFTFSSYYMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3210 - protein, 118 aa, Artificial Sequence; identical to SEQ ID NO: 445
  Description of Artificial Sequence: Synthetic polypeptide
  VH of XENP019239

SEQ ID NO: 3211 - protein, 5 aa, Artificial Sequence
  Description of Artificial Sequence: Synthetic peptide
  XENP019239 vhCDR1
SYYMH

SEQ ID NO: 3212 - protein, 17 aa, Artificial Sequence
  Description of Artificial Sequence: Synthetic peptide
  XENP019239 vhCDR2
FISYDGNNKYYADSVKG

SEQ ID NO: 3213 - protein, 9 aa, Artificial Sequence
  Description of Artificial Sequence: Synthetic peptide
  XENP019239 vhCDR3
TGWLGPFDY

SEQ ID NO: 3214 - protein, 215 aa, Artificial Sequence; identical to SEQ ID NO: 2924
  Description of Artificial Sequence: Synthetic polypeptide
  XENP019239 [CTLA-4]_H0.29_L0_Fab Light Chain

SEQ ID NO: 3215 - protein, 108 aa, Artificial Sequence; identical to SEQ ID NO: 23
  Description of Artificial Sequence: Synthetic polypeptide
  VL of XENP019239

SEQ ID NO: 3216 - protein, 12 aa, Artificial Sequence
  Description of Artificial Sequence: Synthetic peptide
  XENP019239 vlCDR1
RASQSVGSSYLA

SEQ ID NO: 3217 - protein, 7 aa, Artificial Sequence
  Description of Artificial Sequence: Synthetic peptide
  XENP019239 vlCDR2
GAFSRAT

SEQ ID NO: 3218 - protein, 9 aa, Artificial Sequence
  Description of Artificial Sequence: Synthetic peptide
  XENP019239 vlCDR3
QQYGSSPWT

SEQ ID NO: 3219 - protein, 221 aa, Artificial Sequence
  Description of Artificial Sequence: Synthetic polypeptide
  XENP019240 [CTLA-4]_H0.30_L0_Fab Heavy Chain
QVQLVESGGGVVQPGRSLRLSCAASGFTFSSYTMDWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3220 - protein, 118 aa, Artificial Sequence; identical to SEQ ID NO: 454
  Description of Artificial Sequence: Synthetic polypeptide
  VH of XENP019240

SEQ ID NO: 3221 - protein, 5 aa, Artificial Sequence
  Description of Artificial Sequence: Synthetic peptide
  XENP019240 vhCDR1
SYTMD

SEQ ID NO: 3222 - protein, 17 aa, Artificial Sequence
  Description of Artificial Sequence: Synthetic peptide
  XENP019240 vhCDR2
FISYDGNNKYYADSVKG

SEQ ID NO: 3223 - protein, 9 aa, Artificial Sequence
  Description of Artificial Sequence: Synthetic peptide
  XENP019240 vhCDR3
TGWLGPFDY

SEQ ID NO: 3224 - protein, 215 aa, Artificial Sequence; identical to SEQ ID NO: 2924
  Description of Artificial Sequence: Synthetic polypeptide
  XENP019240 [CTLA-4]_H0.30_L0_Fab Light Chain

SEQ ID NO: 3225 - protein, 108 aa, Artificial Sequence; identical to SEQ ID NO: 23
  Description of Artificial Sequence: Synthetic polypeptide
  VL of XENP019240

SEQ ID NO: 3226 - protein, 12 aa, Artificial Sequence
  Description of Artificial Sequence: Synthetic peptide
  XENP019240 vlCDR1
RASQSVGSSYLA

SEQ ID NO: 3227 - protein, 7 aa, Artificial Sequence
  Description of Artificial Sequence: Synthetic peptide
  XENP019240 vlCDR2
GAFSRAT

SEQ ID NO: 3228 - protein, 9 aa, Artificial Sequence
  Description of Artificial Sequence: Synthetic peptide
  XENP019240 vlCDR3
QQYGSSPWT

SEQ ID NO: 3229 - protein, 221 aa, Artificial Sequence
  Description of Artificial Sequence: Synthetic polypeptide
  XENP019241 [CTLA-4]_H0.31_L0_Fab Heavy Chain
QVQLVESGGGVVQPGRSLRLSCAASGFTFSSYTMFWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3230 - protein, 118 aa, Artificial Sequence; identical to SEQ ID NO: 463
  Description of Artificial Sequence: Synthetic polypeptide
  VH of XENP019241

SEQ ID NO: 3231 - protein, 5 aa, Artificial Sequence
  Description of Artificial Sequence: Synthetic peptide
  XENP019241 vhCDR1
SYTMF

SEQ ID NO: 3232 - protein, 17 aa, Artificial Sequence
  Description of Artificial Sequence: Synthetic peptide
  XENP019241 vhCDR2
FISYDGNNKYYADSVKG

SEQ ID NO: 3233 - protein, 9 aa, Artificial Sequence
  Description of Artificial Sequence: Synthetic peptide
  XENP019241 vhCDR3
TGWLGPFDY

SEQ ID NO: 3234 - protein, 215 aa, Artificial Sequence; identical to SEQ ID NO: 2924
  Description of Artificial Sequence: Synthetic polypeptide
  XENP019241 [CTLA-4]_H0.31_L0_Fab Light Chain

SEQ ID NO: 3235 - protein, 108 aa, Artificial Sequence; identical to SEQ ID NO: 23
  Description of Artificial Sequence: Synthetic polypeptide
  VL of XENP019241

SEQ ID NO: 3236 - protein, 12 aa, Artificial Sequence
  Description of Artificial Sequence: Synthetic peptide
  XENP019241 vlCDR1
RASQSVGSSYLA

SEQ ID NO: 3237 - protein, 7 aa, Artificial Sequence
  Description of Artificial Sequence: Synthetic peptide
  XENP019241 vlCDR2
GAFSRAT

SEQ ID NO: 3238 - protein, 9 aa, Artificial Sequence
  Description of Artificial Sequence: Synthetic peptide
  XENP019241 vlCDR3
QQYGSSPWT

SEQ ID NO: 3239 - protein, 221 aa, Artificial Sequence
  Description of Artificial Sequence: Synthetic polypeptide
  XENP019242 [CTLA-4]_H0.32_L0_Fab Heavy Chain
QVQLVESGGGVVQPGRSLRLSCAASGFTFSSYTMNWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3240 - protein, 118 aa, Artificial Sequence; identical to SEQ ID NO: 472
  Description of Artificial Sequence: Synthetic polypeptide
  VH of XENP019242

SEQ ID NO: 3241 - protein, 5 aa, Artificial Sequence
  Description of Artificial Sequence: Synthetic peptide
  XENP019242 vhCDR1
SYTMN

SEQ ID NO: 3242 - protein, 17 aa, Artificial Sequence
  Description of Artificial Sequence: Synthetic peptide
  XENP019242 vhCDR2
FISYDGNNKYYADSVKG

SEQ ID NO: 3243 - protein, 9 aa, Artificial Sequence
  Description of Artificial Sequence: Synthetic peptide
  XENP019242 vhCDR3
TGWLGPFDY

SEQ ID NO: 3244 - protein, 215 aa, Artificial Sequence; identical to SEQ ID NO: 2924
  Description of Artificial Sequence: Synthetic polypeptide
  XENP019242 [CTLA-4]_H0.32_L0_Fab Light Chain

SEQ ID NO: 3245 - protein, 108 aa, Artificial Sequence; identical to SEQ ID NO: 23
  Description of Artificial Sequence: Synthetic polypeptide
  VL of XENP019242

SEQ ID NO: 3246 - protein, 12 aa, Artificial Sequence
  Description of Artificial Sequence: Synthetic peptide
  XENP019242 vlCDR1
RASQSVGSSYLA

SEQ ID NO: 3247 - protein, 7 aa, Artificial Sequence
  Description of Artificial Sequence: Synthetic peptide
  XENP019242 vlCDR2
GAFSRAT

SEQ ID NO: 3248 - protein, 9 aa, Artificial Sequence
  Description of Artificial Sequence: Synthetic peptide
  XENP019242 vlCDR3
QQYGSSPWT

SEQ ID NO: 3249 - protein, 221 aa, Artificial Sequence
  Description of Artificial Sequence: Synthetic polypeptide
  XENP019243 [CTLA-4]_H0.33_L0_Fab Heavy Chain
QVQLVESGGGVVQPGRSLRLSCAASGFTFSSYTMSWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3250 - protein, 118 aa, Artificial Sequence; identical to SEQ ID NO: 481
  Description of Artificial Sequence: Synthetic polypeptide
  VH of XENP019243

SEQ ID NO: 3251 - protein, 5 aa, Artificial Sequence
  Description of Artificial Sequence: Synthetic peptide
  XENP019243 vhCDR1
SYTMS

SEQ ID NO: 3252 - protein, 17 aa, Artificial Sequence
  Description of Artificial Sequence: Synthetic peptide
  XENP019243 vhCDR2
FISYDGNNKYYADSVKG

SEQ ID NO: 3253 - protein, 9 aa, Artificial Sequence
  Description of Artificial Sequence: Synthetic peptide
  XENP019243 vhCDR3
TGWLGPFDY

SEQ ID NO: 3254 - protein, 215 aa, Artificial Sequence; identical to SEQ ID NO: 2924
  Description of Artificial Sequence: Synthetic polypeptide
  XENP019243 [CTLA-4]_H0.33_L0_Fab Light Chain

SEQ ID NO: 3255 - protein, 108 aa, Artificial Sequence; identical to SEQ ID NO: 23
  Description of Artificial Sequence: Synthetic polypeptide
  VL of XENP019243

SEQ ID NO: 3256 - protein, 12 aa, Artificial Sequence
  Description of Artificial Sequence: Synthetic peptide
  XENP019243 vlCDR1
RASQSVGSSYLA

SEQ ID NO: 3257 - protein, 7 aa, Artificial Sequence
  Description of Artificial Sequence: Synthetic peptide
  XENP019243 vlCDR2
GAFSRAT

SEQ ID NO: 3258 - protein, 9 aa, Artificial Sequence
  Description of Artificial Sequence: Synthetic peptide
  XENP019243 vlCDR3
QQYGSSPWT

SEQ ID NO: 3259 - protein, 221 aa, Artificial Sequence
  Description of Artificial Sequence: Synthetic polypeptide
  XENP019244 [CTLA-4]_H0.34_L0_Fab Heavy Chain
QVQLVESGGGVVQPGRSLRLSCAASGFTFSSYTMYWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3260 - protein, 118 aa, Artificial Sequence; identical to SEQ ID NO: 490
  Description of Artificial Sequence: Synthetic polypeptide
  VH of XENP019244

SEQ ID NO: 3261 - protein, 5 aa, Artificial Sequence
  Description of Artificial Sequence: Synthetic peptide
  XENP019244 vhCDR1
SYTMY

SEQ ID NO: 3262 - protein, 17 aa, Artificial Sequence
  Description of Artificial Sequence: Synthetic peptide
  XENP019244 vhCDR2
FISYDGNNKYYADSVKG

SEQ ID NO: 3263 - protein, 9 aa, Artificial Sequence
  Description of Artificial Sequence: Synthetic peptide
  XENP019244 vhCDR3
TGWLGPFDY

SEQ ID NO: 3264 - protein, 215 aa, Artificial Sequence; identical to SEQ ID NO: 2924
  Description of Artificial Sequence: Synthetic polypeptide
  XENP019244 [CTLA-4]_H0.34_L0_Fab Light Chain

SEQ ID NO: 3265 - protein, 108 aa, Artificial Sequence; identical to SEQ ID NO: 23
  Description of Artificial Sequence: Synthetic polypeptide
  VL of XENP019244

SEQ ID NO: 3266 - protein, 12 aa, Artificial Sequence
  Description of Artificial Sequence: Synthetic peptide
  XENP019244 vlCDR1
RASQSVGSSYLA

SEQ ID NO: 3267 - protein, 7 aa, Artificial Sequence
  Description of Artificial Sequence: Synthetic peptide
  XENP019244 vlCDR2
GAFSRAT

SEQ ID NO: 3268 - protein, 9 aa, Artificial Sequence
  Description of Artificial Sequence: Synthetic peptide
  XENP019244 vlCDR3
QQYGSSPWT

SEQ ID NO: 3269 - protein, 221 aa, Artificial Sequence
  Description of Artificial Sequence: Synthetic polypeptide
  XENP019245 [CTLA-4]_H0.35_L0_Fab Heavy Chain
QVQLVESGGGVVQPGRSLRLSCAASGFTFSSYTMHWIRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3270 - protein, 118 aa, Artificial Sequence; identical to SEQ ID NO: 499
  Description of Artificial Sequence: Synthetic polypeptide
  VH of XENP019245

SEQ ID NO: 3271 - protein, 5 aa, Artificial Sequence
  Description of Artificial Sequence: Synthetic peptide
  XENP019245 vhCDR1
SYTMH

SEQ ID NO: 3272 - protein, 17 aa, Artificial Sequence
  Description of Artificial Sequence: Synthetic peptide
  XENP019245 vhCDR2
FISYDGNNKYYADSVKG

SEQ ID NO: 3273 - protein, 9 aa, Artificial Sequence
  Description of Artificial Sequence: Synthetic peptide
  XENP019245 vhCDR3
TGWLGPFDY

SEQ ID NO: 3274 - protein, 215 aa, Artificial Sequence; identical to SEQ ID NO: 2924
  Description of Artificial Sequence: Synthetic polypeptide
  XENP019245 [CTLA-4]_H0.35_L0_Fab Light Chain

SEQ ID NO: 3275 - protein, 108 aa, Artificial Sequence; identical to SEQ ID NO: 23
  Description of Artificial Sequence: Synthetic polypeptide
  VL of XENP019245

SEQ ID NO: 3276 - protein, 12 aa, Artificial Sequence
  Description of Artificial Sequence: Synthetic peptide
  XENP019245 vlCDR1
RASQSVGSSYLA

SEQ ID NO: 3277 - protein, 7 aa, Artificial Sequence
  Description of Artificial Sequence: Synthetic peptide
  XENP019245 vlCDR2
GAFSRAT

SEQ ID NO: 3278 - protein, 9 aa, Artificial Sequence
  Description of Artificial Sequence: Synthetic peptide
  XENP019245 vlCDR3
QQYGSSPWT

SEQ ID NO: 3279 - protein, 221 aa, Artificial Sequence
  Description of Artificial Sequence: Synthetic polypeptide
  XENP019246 [CTLA-4]_H0.36_L0_Fab Heavy Chain
QVQLVESGGGVVQPGRSLRLSCAASGFTFSSYTMHWVRKAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3280 - protein, 118 aa, Artificial Sequence; identical to SEQ ID NO: 31
  Description of Artificial Sequence: Synthetic polypeptide
  VH of XENP019246

SEQ ID NO: 3281 - protein, 5 aa, Artificial Sequence
  Description of Artificial Sequence: Synthetic peptide
  XENP019246 vhCDR1
SYTMH

SEQ ID NO: 3282 - protein, 17 aa, Artificial Sequence
  Description of Artificial Sequence: Synthetic peptide
  XENP019246 vhCDR2
FISYDGNNKYYADSVKG

SEQ ID NO: 3283 - protein, 9 aa, Artificial Sequence
  Description of Artificial Sequence: Synthetic peptide
  XENP019246 vhCDR3
TGWLGPFDY

SEQ ID NO: 3284 - protein, 215 aa, Artificial Sequence; identical to SEQ ID NO: 2924
  Description of Artificial Sequence: Synthetic polypeptide
  XENP019246 [CTLA-4]_H0.36_L0_Fab Light Chain

SEQ ID NO: 3285 - protein, 108 aa, Artificial Sequence; identical to SEQ ID NO: 23
  Description of Artificial Sequence: Synthetic polypeptide
  VL of XENP019246

SEQ ID NO: 3286 - protein, 12 aa, Artificial Sequence
  Description of Artificial Sequence: Synthetic peptide
  XENP019246 vlCDR1
RASQSVGSSYLA

SEQ ID NO: 3287 - protein, 7 aa, Artificial Sequence
  Description of Artificial Sequence: Synthetic peptide
  XENP019246 vlCDR2
GAFSRAT

SEQ ID NO: 3288 - protein, 9 aa, Artificial Sequence
  Description of Artificial Sequence: Synthetic peptide
  XENP019246 vlCDR3
QQYGSSPWT

SEQ ID NO: 3289 - protein, 221 aa, Artificial Sequence
  Description of Artificial Sequence: Synthetic polypeptide
  XENP019247 [CTLA-4]_H0.37_L0_Fab Heavy Chain
QVQLVESGGGVVQPGRSLRLSCAASGFTFSSYTMHWVRQAPGKRLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3290 - protein, 118 aa, Artificial Sequence; identical to SEQ ID NO: 49
  Description of Artificial Sequence: Synthetic polypeptide
  VH of XENP019247

SEQ ID NO: 3291 - protein, 5 aa, Artificial Sequence
  Description of Artificial Sequence: Synthetic peptide
  XENP019247 vhCDR1
SYTMH

SEQ ID NO: 3292 - protein, 17 aa, Artificial Sequence
  Description of Artificial Sequence: Synthetic peptide
  XENP019247 vhCDR2
FISYDGNNKYYADSVKG

SEQ ID NO: 3293 - protein, 9 aa, Artificial Sequence
  Description of Artificial Sequence: Synthetic peptide
  XENP019247 vhCDR3
TGWLGPFDY

SEQ ID NO: 3294 - protein, 215 aa, Artificial Sequence; identical to SEQ ID NO: 2924
  Description of Artificial Sequence: Synthetic polypeptide
  XENP019247 [CTLA-4]_H0.37_L0_Fab Light Chain

SEQ ID NO: 3295 - protein, 108 aa, Artificial Sequence; identical to SEQ ID NO: 23
  Description of Artificial Sequence: Synthetic polypeptide
  VL of XENP019247

SEQ ID NO: 3296 - protein, 12 aa, Artificial Sequence
  Description of Artificial Sequence: Synthetic peptide
  XENP019247 vlCDR1
RASQSVGSSYLA

SEQ ID NO: 3297 - protein, 7 aa, Artificial Sequence
  Description of Artificial Sequence: Synthetic peptide
  XENP019247 vlCDR2
GAFSRAT

SEQ ID NO: 3298 - protein, 9 aa, Artificial Sequence
  Description of Artificial Sequence: Synthetic peptide
  XENP019247 vlCDR3
QQYGSSPWT

SEQ ID NO: 3299 - protein, 221 aa, Artificial Sequence
  Description of Artificial Sequence: Synthetic polypeptide
  XENP019248 [CTLA-4]_H0.38_L0_Fab Heavy Chain
QVQLVESGGGVVQPGRSLRLSCAASGFTFSSYTMHWVRQAPGKGLEWVAFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3300 - protein, 118 aa, Artificial Sequence; identical to SEQ ID NO: 526
  Description of Artificial Sequence: Synthetic polypeptide
  VH of XENP019248

SEQ ID NO: 3301 - protein, 5 aa, Artificial Sequence
  Description of Artificial Sequence: Synthetic peptide
  XENP019248 vhCDR1
SYTMH

SEQ ID NO: 3302 - protein, 17 aa, Artificial Sequence
  Description of Artificial Sequence: Synthetic peptide
  XENP019248 vhCDR2
FISYDGNNKYYADSVKG

SEQ ID NO: 3303 - protein, 9 aa, Artificial Sequence
  Description of Artificial Sequence: Synthetic peptide
  XENP019248 vhCDR3
TGWLGPFDY

SEQ ID NO: 3304 - protein, 215 aa, Artificial Sequence; identical to SEQ ID NO: 2924
  Description of Artificial Sequence: Synthetic polypeptide
  XENP019248 [CTLA-4]_H0.38_L0_Fab Light Chain

SEQ ID NO: 3305 - protein, 108 aa, Artificial Sequence; identical to SEQ ID NO: 23
  Description of Artificial Sequence: Synthetic polypeptide
  VL of XENP019248

SEQ ID NO: 3306 - protein, 12 aa, Artificial Sequence
  Description of Artificial Sequence: Synthetic peptide
  XENP019248 vlCDR1
RASQSVGSSYLA

SEQ ID NO: 3307 - protein, 7 aa, Artificial Sequence
  Description of Artificial Sequence: Synthetic peptide
  XENP019248 vlCDR2
GAFSRAT

SEQ ID NO: 3308 - protein, 9 aa, Artificial Sequence
  Description of Artificial Sequence: Synthetic peptide
  XENP019248 vlCDR3
QQYGSSPWT

SEQ ID NO: 3309 - protein, 221 aa, Artificial Sequence
  Description of Artificial Sequence: Synthetic polypeptide
  XENP019249 [CTLA-4]_H0.39_L0_Fab Heavy Chain
QVQLVESGGGVVQPGRSLRLSCAASGFTFSSYTMHWVRQAPGKGLEWVGFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3310 - protein, 118 aa, Artificial Sequence; identical to SEQ ID NO: 535
  Description of Artificial Sequence: Synthetic polypeptide
  VH of XENP019249

SEQ ID NO: 3311 - protein, 5 aa, Artificial Sequence
  Description of Artificial Sequence: Synthetic peptide
  XENP019249 vhCDR1
SYTMH

SEQ ID NO: 3312 - protein, 17 aa, Artificial Sequence
  Description of Artificial Sequence: Synthetic peptide
  XENP019249 vhCDR2
FISYDGNNKYYADSVKG

SEQ ID NO: 3313 - protein, 9 aa, Artificial Sequence
  Description of Artificial Sequence: Synthetic peptide
  XENP019249 vhCDR3
TGWLGPFDY

SEQ ID NO: 3314 - protein, 215 aa, Artificial Sequence; identical to SEQ ID NO: 2924
  Description of Artificial Sequence: Synthetic polypeptide
  XENP019249 [CTLA-4]_H0.39_L0_Fab Light Chain

SEQ ID NO: 3315 - protein, 108 aa, Artificial Sequence; identical to SEQ ID NO: 23
  Description of Artificial Sequence: Synthetic polypeptide
  VL of XENP019249

SEQ ID NO: 3316 - protein, 12 aa, Artificial Sequence
  Description of Artificial Sequence: Synthetic peptide
  XENP019249 vlCDR1
RASQSVGSSYLA

SEQ ID NO: 3317 - protein, 7 aa, Artificial Sequence
  Description of Artificial Sequence: Synthetic peptide
  XENP019249 vlCDR2
GAFSRAT

SEQ ID NO: 3318 - protein, 9 aa, Artificial Sequence
  Description of Artificial Sequence: Synthetic peptide
  XENP019249 vlCDR3
QQYGSSPWT

SEQ ID NO: 3319 - protein, 221 aa, Artificial Sequence
  Description of Artificial Sequence: Synthetic polypeptide
  XENP019250 [CTLA-4]_H0.40_L0_Fab Heavy Chain
QVQLVESGGGVVQPGRSLRLSCAASGFTFSSYTMHWVRQAPGKGLEWVSFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3320 - protein, 118 aa, Artificial Sequence; identical to SEQ ID NO: 544
  Description of Artificial Sequence: Synthetic polypeptide
  VH of XENP019250

SEQ ID NO: 3321 - protein, 5 aa, Artificial Sequence
  Description of Artificial Sequence: Synthetic peptide
  XENP019250 vhCDR1
SYTMH

SEQ ID NO: 3322 - protein, 17 aa, Artificial Sequence
  Description of Artificial Sequence: Synthetic peptide
  XENP019250 vhCDR2
FISYDGNNKYYADSVKG

SEQ ID NO: 3323 - protein, 9 aa, Artificial Sequence
  Description of Artificial Sequence: Synthetic peptide
  XENP019250 vhCDR3
TGWLGPFDY

SEQ ID NO: 3324 - protein, 215 aa, Artificial Sequence; identical to SEQ ID NO: 2924
  Description of Artificial Sequence: Synthetic polypeptide
  XENP019250 [CTLA-4]_H0.40_L0_Fab Light Chain

SEQ ID NO: 3325 - protein, 108 aa, Artificial Sequence; identical to SEQ ID NO: 23
  Description of Artificial Sequence: Synthetic polypeptide
  VL of XENP019250

SEQ ID NO: 3326 - protein, 12 aa, Artificial Sequence
  Description of Artificial Sequence: Synthetic peptide
  XENP019250 vlCDR1
RASQSVGSSYLA

SEQ ID NO: 3327 - protein, 7 aa, Artificial Sequence
  Description of Artificial Sequence: Synthetic peptide
  XENP019250 vlCDR2
GAFSRAT

SEQ ID NO: 3328 - protein, 9 aa, Artificial Sequence
  Description of Artificial Sequence: Synthetic peptide
  XENP019250 vlCDR3
QQYGSSPWT

SEQ ID NO: 3329 - protein, 221 aa, Artificial Sequence
  Description of Artificial Sequence: Synthetic polypeptide
  XENP019251 [CTLA-4]_H0.41_L0_Fab Heavy Chain
QVQLVESGGGVVQPGRSLRLSCAASGFTFSSYTMHWVRQAPGKGLEWVVFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3330 - protein, 118 aa, Artificial Sequence; identical to SEQ ID NO: 553
  Description of Artificial Sequence: Synthetic polypeptide
  VH of XENP019251

SEQ ID NO: 3331 - protein, 5 aa, Artificial Sequence
  Description of Artificial Sequence: Synthetic peptide
  XENP019251 vhCDR1
SYTMH

SEQ ID NO: 3332 - protein, 17 aa, Artificial Sequence
  Description of Artificial Sequence: Synthetic peptide
  XENP019251 vhCDR2
FISYDGNNKYYADSVKG

SEQ ID NO: 3333 - protein, 9 aa, Artificial Sequence
  Description of Artificial Sequence: Synthetic peptide
  XENP019251 vhCDR3
TGWLGPFDY

SEQ ID NO: 3334 - protein, 215 aa, Artificial Sequence; identical to SEQ ID NO: 2924
  Description of Artificial Sequence: Synthetic polypeptide
  XENP019251 [CTLA-4]_H0.41_L0_Fab Light Chain

SEQ ID NO: 3335 - protein, 108 aa, Artificial Sequence; identical to SEQ ID NO: 23
  Description of Artificial Sequence: Synthetic polypeptide
  VL of XENP019251

SEQ ID NO: 3336 - protein, 12 aa, Artificial Sequence
  Description of Artificial Sequence: Synthetic peptide
  XENP019251 vlCDR1
RASQSVGSSYLA

SEQ ID NO: 3337 - protein, 7 aa, Artificial Sequence
  Description of Artificial Sequence: Synthetic peptide
  XENP019251 vlCDR2
GAFSRAT

SEQ ID NO: 3338 - protein, 9 aa, Artificial Sequence
  Description of Artificial Sequence: Synthetic peptide
  XENP019251 vlCDR3
QQYGSSPWT

SEQ ID NO: 3339 - protein, 221 aa, Artificial Sequence
  Description of Artificial Sequence: Synthetic polypeptide
  XENP019252 [CTLA-4]_H0.42_L0_Fab Heavy Chain
QVQLVESGGGVVQPGRSLRLSCAASGFTFSSYTMHWVRQAPGKGLEWVTAISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3340 - protein, 118 aa, Artificial Sequence; identical to SEQ ID NO: 562
  Description of Artificial Sequence: Synthetic polypeptide
  VH of XENP019252

SEQ ID NO: 3341 - protein, 5 aa, Artificial Sequence
  Description of Artificial Sequence: Synthetic peptide
  XENP019252 vhCDR1
SYTMH

SEQ ID NO: 3342 - protein, 17 aa, Artificial Sequence
  Description of Artificial Sequence: Synthetic peptide
  XENP019252 vhCDR2
AISYDGNNKYYADSVKG

SEQ ID NO: 3343 - protein, 9 aa, Artificial Sequence
  Description of Artificial Sequence: Synthetic peptide
  XENP019252 vhCDR3
TGWLGPFDY

SEQ ID NO: 3344 - protein, 215 aa, Artificial Sequence; identical to SEQ ID NO: 2924
  Description of Artificial Sequence: Synthetic polypeptide
  XENP019252 [CTLA-4]_H0.42_L0_Fab Light Chain

SEQ ID NO: 3345 - protein, 108 aa, Artificial Sequence; identical to SEQ ID NO: 23
  Description of Artificial Sequence: Synthetic polypeptide
  VL of XENP019252

SEQ ID NO: 3346 - protein, 12 aa, Artificial Sequence
  Description of Artificial Sequence: Synthetic peptide
  XENP019252 vlCDR1
RASQSVGSSYLA

SEQ ID NO: 3347 - protein, 7 aa, Artificial Sequence
  Description of Artificial Sequence: Synthetic peptide
  XENP019252 vlCDR2
GAFSRAT

SEQ ID NO: 3348 - protein, 9 aa, Artificial Sequence
  Description of Artificial Sequence: Synthetic peptide
  XENP019252 vlCDR3
QQYGSSPWT

SEQ ID NO: 3349 - protein, 221 aa, Artificial Sequence
  Description of Artificial Sequence: Synthetic polypeptide
  XENP019253 [CTLA-4]_H0.43_L0_Fab Heavy Chain
QVQLVESGGGVVQPGRSLRLSCAASGFTFSSYTMHWVRQAPGKGLEWVTGISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3350 - protein, 118 aa, Artificial Sequence; identical to SEQ ID NO: 571
  Description of Artificial Sequence: Synthetic polypeptide
  VH of XENP019253

SEQ ID NO: 3351 - protein, 5 aa, Artificial Sequence
  Description of Artificial Sequence: Synthetic peptide
  XENP019253 vhCDR1
SYTMH

SEQ ID NO: 3352 - protein, 17 aa, Artificial Sequence
  Description of Artificial Sequence: Synthetic peptide
  XENP019253 vhCDR2
GISYDGNNKYYADSVKG

SEQ ID NO: 3353 - protein, 9 aa, Artificial Sequence
  Description of Artificial Sequence: Synthetic peptide
  XENP019253 vhCDR3
TGWLGPFDY

SEQ ID NO: 3354 - protein, 215 aa, Artificial Sequence; identical to SEQ ID NO: 2924
  Description of Artificial Sequence: Synthetic polypeptide
  XENP019253 [CTLA-4]_H0.43_L0_Fab Light Chain

SEQ ID NO: 3355 - protein, 108 aa, Artificial Sequence; identical to SEQ ID NO: 23
  Description of Artificial Sequence: Synthetic polypeptide
  VL of XENP019253

SEQ ID NO: 3356 - protein, 12 aa, Artificial Sequence
  Description of Artificial Sequence: Synthetic peptide
  XENP019253 vlCDR1
RASQSVGSSYLA

SEQ ID NO: 3357 - protein, 7 aa, Artificial Sequence
  Description of Artificial Sequence: Synthetic peptide
  XENP019253 vlCDR2
GAFSRAT

SEQ ID NO: 3358 - protein, 9 aa, Artificial Sequence
  Description of Artificial Sequence: Synthetic peptide
  XENP019253 vlCDR3
QQYGSSPWT

SEQ ID NO: 3359 - protein, 221 aa, Artificial Sequence
  Description of Artificial Sequence: Synthetic polypeptide
  XENP019254 [CTLA-4]_H0.44_L0_Fab Heavy Chain
QVQLVESGGGVVQPGRSLRLSCAASGFTFSSYTMHWVRQAPGKGLEWVTLISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3360 - protein, 118 aa, Artificial Sequence; identical to SEQ ID NO: 580
  Description of Artificial Sequence: Synthetic polypeptide
  VH of XENP019254

SEQ ID NO: 3361 - protein, 5 aa, Artificial Sequence
  Description of Artificial Sequence: Synthetic peptide
  XENP019254 vhCDR1
SYTMH

SEQ ID NO: 3362 - protein, 17 aa, Artificial Sequence
  Description of Artificial Sequence: Synthetic peptide
  XENP019254 vhCDR2
LISYDGNNKYYADSVKG

SEQ ID NO: 3363 - protein, 9 aa, Artificial Sequence
  Description of Artificial Sequence: Synthetic peptide
  XENP019254 vhCDR3
TGWLGPFDY

SEQ ID NO: 3364 - protein, 215 aa, Artificial Sequence; identical to SEQ ID NO: 2924
  Description of Artificial Sequence: Synthetic polypeptide
  XENP019254 [CTLA-4]_H0.44_L0_Fab Light Chain

SEQ ID NO: 3365 - protein, 108 aa, Artificial Sequence; identical to SEQ ID NO: 23
  Description of Artificial Sequence: Synthetic polypeptide
  VL of XENP019254

SEQ ID NO: 3366 - protein, 12 aa, Artificial Sequence
  Description of Artificial Sequence: Synthetic peptide
  XENP019254 vlCDR1
RASQSVGSSYLA

SEQ ID NO: 3367 - protein, 7 aa, Artificial Sequence
  Description of Artificial Sequence: Synthetic peptide
  XENP019254 vlCDR2
GAFSRAT

SEQ ID NO: 3368 - protein, 9 aa, Artificial Sequence
  Description of Artificial Sequence: Synthetic peptide
  XENP019254 vlCDR3
QQYGSSPWT

SEQ ID NO: 3369 - protein, 221 aa, Artificial Sequence
  Description of Artificial Sequence: Synthetic polypeptide
  XENP019255 [CTLA-4]_H0.45_L0_Fab Heavy Chain
QVQLVESGGGVVQPGRSLRLSCAASGFTFSSYTMHWVRQAPGKGLEWVTIISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3370 - protein, 118 aa, Artificial Sequence; identical to SEQ ID NO: 589
  Description of Artificial Sequence: Synthetic polypeptide
  VH of XENP019255

SEQ ID NO: 3371 - protein, 5 aa, Artificial Sequence
  Description of Artificial Sequence: Synthetic peptide
  XENP019255 vhCDR1
SYTMH

SEQ ID NO: 3372 - protein, 17 aa, Artificial Sequence
  Description of Artificial Sequence: Synthetic peptide
  XENP019255 vhCDR2
IISYDGNNKYYADSVKG

SEQ ID NO: 3373 - protein, 9 aa, Artificial Sequence
  Description of Artificial Sequence: Synthetic peptide
  XENP019255 vhCDR3
TGWLGPFDY

SEQ ID NO: 3374 - protein, 215 aa, Artificial Sequence; identical to SEQ ID NO: 2924
  Description of Artificial Sequence: Synthetic polypeptide
  XENP019255 [CTLA-4]_H0.45_L0_Fab Light Chain

SEQ ID NO: 3375 - protein, 108 aa, Artificial Sequence; identical to SEQ ID NO: 23
  Description of Artificial Sequence: Synthetic polypeptide
  VL of XENP019255

SEQ ID NO: 3376 - protein, 12 aa, Artificial Sequence
  Description of Artificial Sequence: Synthetic peptide
  XENP019255 vlCDR1
RASQSVGSSYLA

SEQ ID NO: 3377 - protein, 7 aa, Artificial Sequence
  Description of Artificial Sequence: Synthetic peptide
  XENP019255 vlCDR2
GAFSRAT

SEQ ID NO: 3378 - protein, 9 aa, Artificial Sequence
  Description of Artificial Sequence: Synthetic peptide
  XENP019255 vlCDR3
QQYGSSPWT

SEQ ID NO: 3379 - protein, 221 aa, Artificial Sequence
  Description of Artificial Sequence: Synthetic polypeptide
  XENP019256 [CTLA-4]_H0.46_L0_Fab Heavy Chain
QVQLVESGGGVVQPGRSLRLSCAASGFTFSSYTMHWVRQAPGKGLEWVTRISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3380 - protein, 118 aa, Artificial Sequence; identical to SEQ ID NO: 598
  Description of Artificial Sequence: Synthetic polypeptide
  VH of XENP019256

SEQ ID NO: 3381 - protein, 5 aa, Artificial Sequence
  Description of Artificial Sequence: Synthetic peptide
  XENP019256 vhCDR1
SYTMH

SEQ ID NO: 3382 - protein, 17 aa, Artificial Sequence
  Description of Artificial Sequence: Synthetic peptide
  XENP019256 vhCDR2
RISYDGNNKYYADSVKG

SEQ ID NO: 3383 - protein, 9 aa, Artificial Sequence
  Description of Artificial Sequence: Synthetic peptide
  XENP019256 vhCDR3
TGWLGPFDY

SEQ ID NO: 3384 - protein, 215 aa, Artificial Sequence; identical to SEQ ID NO: 2924
  Description of Artificial Sequence: Synthetic polypeptide
  XENP019256 [CTLA-4]_H0.46_L0_Fab Light Chain

SEQ ID NO: 3385 - protein, 108 aa, Artificial Sequence; identical to SEQ ID NO: 23
  Description of Artificial Sequence: Synthetic polypeptide
  VL of XENP019256

SEQ ID NO: 3386 - protein, 12 aa, Artificial Sequence
  Description of Artificial Sequence: Synthetic peptide
  XENP019256 vlCDR1
RASQSVGSSYLA

SEQ ID NO: 3387 - protein, 7 aa, Artificial Sequence
  Description of Artificial Sequence: Synthetic peptide
  XENP019256 vlCDR2
GAFSRAT

SEQ ID NO: 3388 - protein, 9 aa, Artificial Sequence
  Description of Artificial Sequence: Synthetic peptide
  XENP019256 vlCDR3
QQYGSSPWT

SEQ ID NO: 3389 - protein, 221 aa, Artificial Sequence
  Description of Artificial Sequence: Synthetic polypeptide
  XENP019257 [CTLA-4]_H0.47_L0_Fab Heavy Chain
QVQLVESGGGVVQPGRSLRLSCAASGFTFSSYTMHWVRQAPGKGLEWVTVISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3390 - protein, 118 aa, Artificial Sequence; identical to SEQ ID NO: 607
  Description of Artificial Sequence: Synthetic polypeptide
  VH of XENP019257

SEQ ID NO: 3391 - protein, 5 aa, Artificial Sequence
  Description of Artificial Sequence: Synthetic peptide
  XENP019257 vhCDR1
SYTMH

SEQ ID NO: 3392 - protein, 17 aa, Artificial Sequence
  Description of Artificial Sequence: Synthetic peptide
  XENP019257 vhCDR2
VISYDGNNKYYADSVKG

SEQ ID NO: 3393 - protein, 9 aa, Artificial Sequence
  Description of Artificial Sequence: Synthetic peptide
  XENP019257 vhCDR3
TGWLGPFDY

SEQ ID NO: 3394 - protein, 215 aa, Artificial Sequence; identical to SEQ ID NO: 2924
  Description of Artificial Sequence: Synthetic polypeptide
  XENP019257 [CTLA-4]_H0.47_L0_Fab Light Chain

SEQ ID NO: 3395 - protein, 108 aa, Artificial Sequence; identical to SEQ ID NO: 23
  Description of Artificial Sequence: Synthetic polypeptide
  VL of XENP019257

SEQ ID NO: 3396 - protein, 12 aa, Artificial Sequence
  Description of Artificial Sequence: Synthetic peptide
  XENP019257 vlCDR1
RASQSVGSSYLA

SEQ ID NO: 3397 - protein, 7 aa, Artificial Sequence
  Description of Artificial Sequence: Synthetic peptide
  XENP019257 vlCDR2
GAFSRAT

SEQ ID NO: 3398 - protein, 9 aa, Artificial Sequence
  Description of Artificial Sequence: Synthetic peptide
  XENP019257 vlCDR3
QQYGSSPWT

SEQ ID NO: 3399 - protein, 221 aa, Artificial Sequence
  Description of Artificial Sequence: Synthetic polypeptide
  XENP019258 [CTLA-4]_H0.48_L0_Fab Heavy Chain
QVQLVESGGGVVQPGRSLRLSCAASGFTFSSYTMHWVRQAPGKGLEWVTYISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3400 - protein, 118 aa, Artificial Sequence; identical to SEQ ID NO: 616
  Description of Artificial Sequence: Synthetic polypeptide
  VH of XENP019258

SEQ ID NO: 3401 - protein, 5 aa, Artificial Sequence
  Description of Artificial Sequence: Synthetic peptide
  XENP019258 vhCDR1
SYTMH

SEQ ID NO: 3402 - protein, 17 aa, Artificial Sequence
  Description of Artificial Sequence: Synthetic peptide
  XENP019258 vhCDR2
YISYDGNNKYYADSVKG

SEQ ID NO: 3403 - protein, 9 aa, Artificial Sequence
  Description of Artificial Sequence: Synthetic peptide
  XENP019258 vhCDR3
TGWLGPFDY

SEQ ID NO: 3404 - protein, 215 aa, Artificial Sequence; identical to SEQ ID NO: 2924
  Description of Artificial Sequence: Synthetic polypeptide
  XENP019258 [CTLA-4]_H0.48_L0_Fab Light Chain

SEQ ID NO: 3405 - protein, 108 aa, Artificial Sequence; identical to SEQ ID NO: 23
  Description of Artificial Sequence: Synthetic polypeptide
  VL of XENP019258

SEQ ID NO: 3406 - protein, 12 aa, Artificial Sequence
  Description of Artificial Sequence: Synthetic peptide
  XENP019258 vlCDR1
RASQSVGSSYLA

SEQ ID NO: 3407 - protein, 7 aa, Artificial Sequence
  Description of Artificial Sequence: Synthetic peptide
  XENP019258 vlCDR2
GAFSRAT

SEQ ID NO: 3408 - protein, 9 aa, Artificial Sequence
  Description of Artificial Sequence: Synthetic peptide
  XENP019258 vlCDR3
QQYGSSPWT

SEQ ID NO: 3409 - protein, 221 aa, Artificial Sequence
  Description of Artificial Sequence: Synthetic polypeptide
  XENP019259 [CTLA-4]_H0.49_L0_Fab Heavy Chain
QVQLVESGGGVVQPGRSLRLSCAASGFTFSSYTMHWVRQAPGKGLEWVTFESYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3410 - protein, 118 aa, Artificial Sequence; identical to SEQ ID NO: 625
  Description of Artificial Sequence: Synthetic polypeptide
  VH of XENP019259

SEQ ID NO: 3411 - protein, 5 aa, Artificial Sequence
  Description of Artificial Sequence: Synthetic peptide
  XENP019259 vhCDR1
SYTMH

SEQ ID NO: 3412 - protein, 17 aa, Artificial Sequence
  Description of Artificial Sequence: Synthetic peptide
  XENP019259 vhCDR2
FESYDGNNKYYADSVKG

SEQ ID NO: 3413 - protein, 9 aa, Artificial Sequence
  Description of Artificial Sequence: Synthetic peptide
  XENP019259 vhCDR3
TGWLGPFDY

SEQ ID NO: 3414 - protein, 215 aa, Artificial Sequence; identical to SEQ ID NO: 2924
  Description of Artificial Sequence: Synthetic polypeptide
  XENP019259 [CTLA-4]_H0.49_L0_Fab Light Chain

SEQ ID NO: 3415 - protein, 108 aa, Artificial Sequence; identical to SEQ ID NO: 23
  Description of Artificial Sequence: Synthetic polypeptide
  VL of XENP019259

SEQ ID NO: 3416 - protein, 12 aa, Artificial Sequence
  Description of Artificial Sequence: Synthetic peptide
  XENP019259 vlCDR1
RASQSVGSSYLA

SEQ ID NO: 3417 - protein, 7 aa, Artificial Sequence
  Description of Artificial Sequence: Synthetic peptide
  XENP019259 vlCDR2
GAFSRAT

SEQ ID NO: 3418 - protein, 9 aa, Artificial Sequence
  Description of Artificial Sequence: Synthetic peptide
  XENP019259 vlCDR3
QQYGSSPWT

SEQ ID NO: 3419 - protein, 221 aa, Artificial Sequence
  Description of Artificial Sequence: Synthetic polypeptide
  XENP019260 [CTLA-4]_H0.50_L0_Fab Heavy Chain
QVQLVESGGGVVQPGRSLRLSCAASGFTFSSYTMHWVRQAPGKGLEWVTFHSYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3420 - protein, 118 aa, Artificial Sequence; identical to SEQ ID NO: 634
  Description of Artificial Sequence: Synthetic polypeptide
  VH of XENP019260

SEQ ID NO: 3421 - protein, 5 aa, Artificial Sequence
  Description of Artificial Sequence: Synthetic peptide
  XENP019260 vhCDR1
SYTMH

SEQ ID NO: 3422 - protein, 17 aa, Artificial Sequence
  Description of Artificial Sequence: Synthetic peptide
  XENP019260 vhCDR2
FHSYDGNNKYYADSVKG

SEQ ID NO: 3423 - protein, 9 aa, Artificial Sequence
  Description of Artificial Sequence: Synthetic peptide
  XENP019260 vhCDR3
TGWLGPFDY

SEQ ID NO: 3424 - protein, 215 aa, Artificial Sequence; identical to SEQ ID NO: 2924
  Description of Artificial Sequence: Synthetic polypeptide
  XENP019260 [CTLA-4]_H0.50_L0_Fab Light Chain

SEQ ID NO: 3425 - protein, 108 aa, Artificial Sequence; identical to SEQ ID NO: 23
  Description of Artificial Sequence: Synthetic polypeptide
  VL of XENP019260

SEQ ID NO: 3426 - protein, 12 aa, Artificial Sequence
  Description of Artificial Sequence: Synthetic peptide
  XENP019260 vlCDR1
RASQSVGSSYLA

SEQ ID NO: 3427 - protein, 7 aa, Artificial Sequence
  Description of Artificial Sequence: Synthetic peptide
  XENP019260 vlCDR2
GAFSRAT

SEQ ID NO: 3428 - protein, 9 aa, Artificial Sequence
  Description of Artificial Sequence: Synthetic peptide
  XENP019260 vlCDR3
QQYGSSPWT

SEQ ID NO: 3429 - protein, 221 aa, Artificial Sequence
  Description of Artificial Sequence: Synthetic polypeptide
  XENP019261 [CTLA-4]_H0.51_L0_Fab Heavy Chain
QVQLVESGGGVVQPGRSLRLSCAASGFTFSSYTMHWVRQAPGKGLEWVTFTSYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3430 - protein, 118 aa, Artificial Sequence; identical to SEQ ID NO: 643
  Description of Artificial Sequence: Synthetic polypeptide
  VH of XENP019261

SEQ ID NO: 3431 - protein, 5 aa, Artificial Sequence
  Description of Artificial Sequence: Synthetic peptide
  XENP019261 vhCDR1
SYTMH

SEQ ID NO: 3432 - protein, 17 aa, Artificial Sequence
  Description of Artificial Sequence: Synthetic peptide
  XENP019261 vhCDR2
FTSYDGNNKYYADSVKG

SEQ ID NO: 3433 - protein, 9 aa, Artificial Sequence
  Description of Artificial Sequence: Synthetic peptide
  XENP019261 vhCDR3
TGWLGPFDY

SEQ ID NO: 3434 - protein, 215 aa, Artificial Sequence; identical to SEQ ID NO: 2924
  Description of Artificial Sequence: Synthetic polypeptide
  XENP019261 [CTLA-4]_H0.51_L0_Fab Light Chain

SEQ ID NO: 3435 - protein, 108 aa, Artificial Sequence; identical to SEQ ID NO: 23
  Description of Artificial Sequence: Synthetic polypeptide
  VL of XENP019261

SEQ ID NO: 3436 - protein, 12 aa, Artificial Sequence
  Description of Artificial Sequence: Synthetic peptide
  XENP019261 vlCDR1
RASQSVGSSYLA

SEQ ID NO: 3437 - protein, 7 aa, Artificial Sequence
  Description of Artificial Sequence: Synthetic peptide
  XENP019261 vlCDR2
GAFSRAT

SEQ ID NO: 3438 - protein, 9 aa, Artificial Sequence
  Description of Artificial Sequence: Synthetic peptide
  XENP019261 vlCDR3
QQYGSSPWT

SEQ ID NO: 3439 - protein, 221 aa, Artificial Sequence
  Description of Artificial Sequence: Synthetic polypeptide
  XENP019262 [CTLA-4]_H0.52_L0_Fab Heavy Chain
QVQLVESGGGVVQPGRSLRLSCAASGFTFSSYTMHWVRQAPGKGLEWVTFVSYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3440 - protein, 118 aa, Artificial Sequence; identical to SEQ ID NO: 652
  Description of Artificial Sequence: Synthetic polypeptide
  VH of XENP019262

SEQ ID NO: 3441 - protein, 5 aa, Artificial Sequence
  Description of Artificial Sequence: Synthetic peptide
  XENP019262 vhCDR1
SYTMH

SEQ ID NO: 3442 - protein, 17 aa, Artificial Sequence
  Description of Artificial Sequence: Synthetic peptide
  XENP019262 vhCDR2
FVSYDGNNKYYADSVKG

SEQ ID NO: 3443 - protein, 9 aa, Artificial Sequence
  Description of Artificial Sequence: Synthetic peptide
  XENP019262 vhCDR3
TGWLGPFDY

SEQ ID NO: 3444 - protein, 215 aa, Artificial Sequence; identical to SEQ ID NO: 2924
  Description of Artificial Sequence: Synthetic polypeptide
  XENP019262 [CTLA-4]_H0.52_L0_Fab Light Chain

SEQ ID NO: 3445 - protein, 108 aa, Artificial Sequence; identical to SEQ ID NO: 23
  Description of Artificial Sequence: Synthetic polypeptide
  VL of XENP019262

SEQ ID NO: 3446 - protein, 12 aa, Artificial Sequence
  Description of Artificial Sequence: Synthetic peptide
  XENP019262 vlCDR1
RASQSVGSSYLA

SEQ ID NO: 3447 - protein, 7 aa, Artificial Sequence
  Description of Artificial Sequence: Synthetic peptide
  XENP019262 vlCDR2
GAFSRAT

SEQ ID NO: 3448 - protein, 9 aa, Artificial Sequence
  Description of Artificial Sequence: Synthetic peptide
  XENP019262 vlCDR3
QQYGSSPWT

SEQ ID NO: 3449 - protein, 221 aa, Artificial Sequence
  Description of Artificial Sequence: Synthetic polypeptide
  XENP019263 [CTLA-4]_H0.53_L0_Fab Heavy Chain
QVQLVESGGGVVQPGRSLRLSCAASGFTFSSYTMHWVRQAPGKGLEWVTFYSYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3450 - protein, 118 aa, Artificial Sequence; identical to SEQ ID NO: 661
  Description of Artificial Sequence: Synthetic polypeptide
  VH of XENP019263

SEQ ID NO: 3451 - protein, 5 aa, Artificial Sequence
  Description of Artificial Sequence: Synthetic peptide
  XENP019263 vhCDR1
SYTMH

SEQ ID NO: 3452 - protein, 17 aa, Artificial Sequence
  Description of Artificial Sequence: Synthetic peptide
  XENP019263 vhCDR2
FYSYDGNNKYYADSVKG

SEQ ID NO: 3453 - protein, 9 aa, Artificial Sequence
  Description of Artificial Sequence: Synthetic peptide
  XENP019263 vhCDR3
TGWLGPFDY

SEQ ID NO: 3454 - protein, 215 aa, Artificial Sequence; identical to SEQ ID NO: 2924
  Description of Artificial Sequence: Synthetic polypeptide
  XENP019263 [CTLA-4]_H0.53_L0_Fab Light Chain

SEQ ID NO: 3455 - protein, 108 aa, Artificial Sequence; identical to SEQ ID NO: 23
  Description of Artificial Sequence: Synthetic polypeptide
  VL of XENP019263

SEQ ID NO: 3456 - protein, 12 aa, Artificial Sequence
  Description of Artificial Sequence: Synthetic peptide
  XENP019263 vlCDR1
RASQSVGSSYLA

SEQ ID NO: 3457 - protein, 7 aa, Artificial Sequence
  Description of Artificial Sequence: Synthetic peptide
  XENP019263 vlCDR2
GAFSRAT

SEQ ID NO: 3458 - protein, 9 aa, Artificial Sequence
  Description of Artificial Sequence: Synthetic peptide
  XENP019263 vlCDR3
QQYGSSPWT

SEQ ID NO: 3459 - protein, 221 aa, Artificial Sequence
  Description of Artificial Sequence: Synthetic polypeptide
  XENP019264 [CTLA-4]_H0.54_L0_Fab Heavy Chain
QVQLVESGGGVVQPGRSLRLSCAASGFTFSSYTMHWVRQAPGKGLEWVTFISGDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3460 - protein, 118 aa, Artificial Sequence; identical to SEQ ID NO: 670
  Description of Artificial Sequence: Synthetic polypeptide
  VH of XENP019264

SEQ ID NO: 3461 - protein, 5 aa, Artificial Sequence
  Description of Artificial Sequence: Synthetic peptide
  XENP019264 vhCDR1
SYTMH

SEQ ID NO: 3462 - protein, 17 aa, Artificial Sequence
  Description of Artificial Sequence: Synthetic peptide
  XENP019264 vhCDR2
FISGDGNNKYYADSVKG

SEQ ID NO: 3463 - protein, 9 aa, Artificial Sequence
  Description of Artificial Sequence: Synthetic peptide
  XENP019264 vhCDR3
TGWLGPFDY

SEQ ID NO: 3464 - protein, 215 aa, Artificial Sequence; identical to SEQ ID NO: 2924
  Description of Artificial Sequence: Synthetic polypeptide
  XENP019264 [CTLA-4]_H0.54_L0_Fab Light Chain

SEQ ID NO: 3465 - protein, 108 aa, Artificial Sequence; identical to SEQ ID NO: 23
  Description of Artificial Sequence: Synthetic polypeptide
  VL of XENP019264

SEQ ID NO: 3466 - protein, 12 aa, Artificial Sequence
  Description of Artificial Sequence: Synthetic peptide
  XENP019264 vlCDR1
RASQSVGSSYLA

SEQ ID NO: 3467 - protein, 7 aa, Artificial Sequence
  Description of Artificial Sequence: Synthetic peptide
  XENP019264 vlCDR2
GAFSRAT

SEQ ID NO: 3468 - protein, 9 aa, Artificial Sequence
  Description of Artificial Sequence: Synthetic peptide
  XENP019264 vlCDR3
QQYGSSPWT

SEQ ID NO: 3469 - protein, 221 aa, Artificial Sequence
  Description of Artificial Sequence: Synthetic polypeptide
  XENP019265 [CTLA-4]_H0.55_L0_Fab Heavy Chain
QVQLVESGGGVVQPGRSLRLSCAASGFTFSSYTMHWVRQAPGKGLEWVTFISNDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3470 - protein, 118 aa, Artificial Sequence; identical to SEQ ID NO: 679
  Description of Artificial Sequence: Synthetic polypeptide
  VH of XENP019265

SEQ ID NO: 3471 - protein, 5 aa, Artificial Sequence
  Description of Artificial Sequence: Synthetic peptide
  XENP019265 vhCDR1
SYTMH

SEQ ID NO: 3472 - protein, 17 aa, Artificial Sequence
  Description of Artificial Sequence: Synthetic peptide
  XENP019265 vhCDR2
FISNDGNNKYYADSVKG

SEQ ID NO: 3473 - protein, 9 aa, Artificial Sequence
  Description of Artificial Sequence: Synthetic peptide
  XENP019265 vhCDR3
TGWLGPFDY

SEQ ID NO: 3474 - protein, 215 aa, Artificial Sequence; identical to SEQ ID NO: 2924
  Description of Artificial Sequence: Synthetic polypeptide
  XENP019265 [CTLA-4]_H0.55_L0_Fab Light Chain

SEQ ID NO: 3475 - protein, 108 aa, Artificial Sequence; identical to SEQ ID NO: 23
  Description of Artificial Sequence: Synthetic polypeptide
  VL of XENP019265

SEQ ID NO: 3476 - protein, 12 aa, Artificial Sequence
  Description of Artificial Sequence: Synthetic peptide
  XENP019265 vlCDR1
RASQSVGSSYLA

SEQ ID NO: 3477 - protein, 7 aa, Artificial Sequence
  Description of Artificial Sequence: Synthetic peptide
  XENP019265 vlCDR2
GAFSRAT

SEQ ID NO: 3478 - protein, 9 aa, Artificial Sequence
  Description of Artificial Sequence: Synthetic peptide
  XENP019265 vlCDR3
QQYGSSPWT

SEQ ID NO: 3479 - protein, 221 aa, Artificial Sequence
  Description of Artificial Sequence: Synthetic polypeptide
  XENP019266 [CTLA-4]_H0.56_L0_Fab Heavy Chain
QVQLVESGGGVVQPGRSLRLSCAASGFTFSSYTMHWVRQAPGKGLEWVTFISSDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3480 - protein, 118 aa, Artificial Sequence; identical to SEQ ID NO: 688
  Description of Artificial Sequence: Synthetic polypeptide
  VH of XENP019266

SEQ ID NO: 3481 - protein, 5 aa, Artificial Sequence
  Description of Artificial Sequence: Synthetic peptide
  XENP019266 vhCDR1
SYTMH

SEQ ID NO: 3482 - protein, 17 aa, Artificial Sequence
  Description of Artificial Sequence: Synthetic peptide
  XENP019266 vhCDR2
FISSDGNNKYYADSVKG

SEQ ID NO: 3483 - protein, 9 aa, Artificial Sequence
  Description of Artificial Sequence: Synthetic peptide
  XENP019266 vhCDR3
TGWLGPFDY

SEQ ID NO: 3484 - protein, 215 aa, Artificial Sequence; identical to SEQ ID NO: 2924
  Description of Artificial Sequence: Synthetic polypeptide
  XENP019266 [CTLA-4]_H0.56_L0_Fab Light Chain

SEQ ID NO: 3485 - protein, 108 aa, Artificial Sequence; identical to SEQ ID NO: 23
  Description of Artificial Sequence: Synthetic polypeptide
  VL of XENP019266

SEQ ID NO: 3486 - protein, 12 aa, Artificial Sequence
  Description of Artificial Sequence: Synthetic peptide
  XENP019266 vlCDR1
RASQSVGSSYLA

SEQ ID NO: 3487 - protein, 7 aa, Artificial Sequence
  Description of Artificial Sequence: Synthetic peptide
  XENP019266 vlCDR2
GAFSRAT

SEQ ID NO: 3488 - protein, 9 aa, Artificial Sequence
  Description of Artificial Sequence: Synthetic peptide
  XENP019266 vlCDR3
QQYGSSPWT

SEQ ID NO: 3489 - protein, 221 aa, Artificial Sequence
  Description of Artificial Sequence: Synthetic polypeptide
  XENP019267 [CTLA-4]_H0.57_L0_Fab Heavy Chain
QVQLVESGGGVVQPGRSLRLSCAASGFTFSSYTMHWVRQAPGKGLEWVTFISYNGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3490 - protein, 118 aa, Artificial Sequence; identical to SEQ ID NO: 697
  Description of Artificial Sequence: Synthetic polypeptide
  VH of XENP019267

SEQ ID NO: 3491 - protein, 5 aa, Artificial Sequence
  Description of Artificial Sequence: Synthetic peptide
  XENP019267 vhCDR1
SYTMH

SEQ ID NO: 3492 - protein, 17 aa, Artificial Sequence
  Description of Artificial Sequence: Synthetic peptide
  XENP019267 vhCDR2
FISYNGNNKYYADSVKG

SEQ ID NO: 3493 - protein, 9 aa, Artificial Sequence
  Description of Artificial Sequence: Synthetic peptide
  XENP019267 vhCDR3
TGWLGPFDY

SEQ ID NO: 3494 - protein, 215 aa, Artificial Sequence; identical to SEQ ID NO: 2924
  Description of Artificial Sequence: Synthetic polypeptide
  XENP019267 [CTLA-4]_H0.57_L0_Fab Light Chain

SEQ ID NO: 3495 - protein, 108 aa, Artificial Sequence; identical to SEQ ID NO: 23
  Description of Artificial Sequence: Synthetic polypeptide
  VL of XENP019267

SEQ ID NO: 3496 - protein, 12 aa, Artificial Sequence
  Description of Artificial Sequence: Synthetic peptide
  XENP019267 vlCDR1
RASQSVGSSYLA

SEQ ID NO: 3497 - protein, 7 aa, Artificial Sequence
  Description of Artificial Sequence: Synthetic peptide
  XENP019267 vlCDR2
GAFSRAT

SEQ ID NO: 3498 - protein, 9 aa, Artificial Sequence
  Description of Artificial Sequence: Synthetic peptide
  XENP019267 vlCDR3
QQYGSSPWT

SEQ ID NO: 3499 - protein, 221 aa, Artificial Sequence
  Description of Artificial Sequence: Synthetic polypeptide
  XENP019268 [CTLA-4]_H0.58_L0_Fab Heavy Chain
QVQLVESGGGVVQPGRSLRLSCAASGFTFSSYTMHWVRQAPGKGLEWVTFISYSGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3500 - protein, 118 aa, Artificial Sequence; identical to SEQ ID NO: 706
  Description of Artificial Sequence: Synthetic polypeptide
  VH of XENP019268

SEQ ID NO: 3501 - protein, 5 aa, Artificial Sequence
  Description of Artificial Sequence: Synthetic peptide
  XENP019268 vhCDR1
SYTMH

SEQ ID NO: 3502 - protein, 17 aa, Artificial Sequence
  Description of Artificial Sequence: Synthetic peptide
  XENP019268 vhCDR2
FISYSGNNKYYADSVKG

SEQ ID NO: 3503 - protein, 9 aa, Artificial Sequence
  Description of Artificial Sequence: Synthetic peptide
  XENP019268 vhCDR3
TGWLGPFDY

SEQ ID NO: 3504 - protein, 215 aa, Artificial Sequence; identical to SEQ ID NO: 2924
  Description of Artificial Sequence: Synthetic polypeptide
  XENP019268 [CTLA-4]_H0.58_L0_Fab Light Chain

SEQ ID NO: 3505 - protein, 108 aa, Artificial Sequence; identical to SEQ ID NO: 23
  Description of Artificial Sequence: Synthetic polypeptide
  VL of XENP019268

SEQ ID NO: 3506 - protein, 12 aa, Artificial Sequence
  Description of Artificial Sequence: Synthetic peptide
  XENP019268 vlCDR1
RASQSVGSSYLA

SEQ ID NO: 3507 - protein, 7 aa, Artificial Sequence
  Description of Artificial Sequence: Synthetic peptide
  XENP019268 vlCDR2
GAFSRAT

SEQ ID NO: 3508 - protein, 9 aa, Artificial Sequence
  Description of Artificial Sequence: Synthetic peptide
  XENP019268 vlCDR3
QQYGSSPWT

SEQ ID NO: 3509 - protein, 221 aa, Artificial Sequence
  Description of Artificial Sequence: Synthetic polypeptide
  XENP019269 [CTLA-4]_H0.59_L0_Fab Heavy Chain
QVQLVESGGGVVQPGRSLRLSCAASGFTFSSYTMHWVRQAPGKGLEWVTFISYEGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3510 - protein, 118 aa, Artificial Sequence; identical to SEQ ID NO: 715
  Description of Artificial Sequence: Synthetic polypeptide
  VH of XENP019269

SEQ ID NO: 3511 - protein, 5 aa, Artificial Sequence
  Description of Artificial Sequence: Synthetic peptide
  XENP019269 vhCDR1
SYTMH

SEQ ID NO: 3512 - protein, 17 aa, Artificial Sequence
  Description of Artificial Sequence: Synthetic peptide
  XENP019269 vhCDR2
FISYEGNNKYYADSVKG

SEQ ID NO: 3513 - protein, 9 aa, Artificial Sequence
  Description of Artificial Sequence: Synthetic peptide
  XENP019269 vhCDR3
TGWLGPFDY

SEQ ID NO: 3514 - protein, 215 aa, Artificial Sequence; identical to SEQ ID NO: 2924
  Description of Artificial Sequence: Synthetic polypeptide
  XENP019269 [CTLA-4]_H0.59_L0_Fab Light Chain

SEQ ID NO: 3515 - protein, 108 aa, Artificial Sequence; identical to SEQ ID NO: 23
  Description of Artificial Sequence: Synthetic polypeptide
  VL of XENP019269

SEQ ID NO: 3516 - protein, 12 aa, Artificial Sequence
  Description of Artificial Sequence: Synthetic peptide
  XENP019269 vlCDR1
RASQSVGSSYLA

SEQ ID NO: 3517 - protein, 7 aa, Artificial Sequence
  Description of Artificial Sequence: Synthetic peptide
  XENP019269 vlCDR2
GAFSRAT

SEQ ID NO: 3518 - protein, 9 aa, Artificial Sequence
  Description of Artificial Sequence: Synthetic peptide
  XENP019269 vlCDR3
QQYGSSPWT

SEQ ID NO: 3519 - protein, 221 aa, Artificial Sequence
  Description of Artificial Sequence: Synthetic polypeptide
  XENP019270 [CTLA-4]_H0.60_L0_Fab Heavy Chain
QVQLVESGGGVVQPGRSLRLSCAASGFTFSSYTMHWVRQAPGKGLEWVTFISYHGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3520 - protein, 118 aa, Artificial Sequence; identical to SEQ ID NO: 724
  Description of Artificial Sequence: Synthetic polypeptide
  VH of XENP019270

SEQ ID NO: 3521 - protein, 5 aa, Artificial Sequence
  Description of Artificial Sequence: Synthetic peptide
  XENP019270 vhCDR1
SYTMH

SEQ ID NO: 3522 - protein, 17 aa, Artificial Sequence
  Description of Artificial Sequence: Synthetic peptide
  XENP019270 vhCDR2
FISYHGNNKYYADSVKG

SEQ ID NO: 3523 - protein, 9 aa, Artificial Sequence
  Description of Artificial Sequence: Synthetic peptide
  XENP019270 vhCDR3
TGWLGPFDY

SEQ ID NO: 3524 - protein, 215 aa, Artificial Sequence; identical to SEQ ID NO: 2924
  Description of Artificial Sequence: Synthetic polypeptide
  XENP019270 [CTLA-4]_H0.60_L0_Fab Light Chain

SEQ ID NO: 3525 - protein, 108 aa, Artificial Sequence; identical to SEQ ID NO: 23
  Description of Artificial Sequence: Synthetic polypeptide
  VL of XENP019270

SEQ ID NO: 3526 - protein, 12 aa, Artificial Sequence
  Description of Artificial Sequence: Synthetic peptide
  XENP019270 vlCDR1
RASQSVGSSYLA

SEQ ID NO: 3527 - protein, 7 aa, Artificial Sequence
  Description of Artificial Sequence: Synthetic peptide
  XENP019270 vlCDR2
GAFSRAT

SEQ ID NO: 3528 - protein, 9 aa, Artificial Sequence
  Description of Artificial Sequence: Synthetic peptide
  XENP019270 vlCDR3
QQYGSSPWT

SEQ ID NO: 3529 - protein, 221 aa, Artificial Sequence
  Description of Artificial Sequence: Synthetic polypeptide
  XENP019271 [CTLA-4]_H0.61_L0_Fab Heavy Chain
QVQLVESGGGVVQPGRSLRLSCAASGFTFSSYTMHWVRQAPGKGLEWVTFISYKGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3530 - protein, 118 aa, Artificial Sequence; identical to SEQ ID NO: 733
  Description of Artificial Sequence: Synthetic polypeptide
  VH of XENP019271

SEQ ID NO: 3531 - protein, 5 aa, Artificial Sequence
  Description of Artificial Sequence: Synthetic peptide
  XENP019271 vhCDR1
SYTMH

SEQ ID NO: 3532 - protein, 17 aa, Artificial Sequence
  Description of Artificial Sequence: Synthetic peptide
  XENP019271 vhCDR2
FISYKGNNKYYADSVKG

SEQ ID NO: 3533 - protein, 9 aa, Artificial Sequence
  Description of Artificial Sequence: Synthetic peptide
  XENP019271 vhCDR3
TGWLGPFDY

SEQ ID NO: 3534 - protein, 215 aa, Artificial Sequence; identical to SEQ ID NO: 2924
  Description of Artificial Sequence: Synthetic polypeptide
  XENP019271 [CTLA-4]_H0.61_L0_Fab Light Chain

SEQ ID NO: 3535 - protein, 108 aa, Artificial Sequence; identical to SEQ ID NO: 23
  Description of Artificial Sequence: Synthetic polypeptide
  VL of XENP019271

SEQ ID NO: 3536 - protein, 12 aa, Artificial Sequence
  Description of Artificial Sequence: Synthetic peptide
  XENP019271 vlCDR1
RASQSVGSSYLA

SEQ ID NO: 3537 - protein, 7 aa, Artificial Sequence
  Description of Artificial Sequence: Synthetic peptide
  XENP019271 vlCDR2
GAFSRAT

SEQ ID NO: 3538 - protein, 9 aa, Artificial Sequence
  Description of Artificial Sequence: Synthetic peptide
  XENP019271 vlCDR3
QQYGSSPWT

SEQ ID NO: 3539 - protein, 221 aa, Artificial Sequence
  Description of Artificial Sequence: Synthetic polypeptide
  XENP019272 [CTLA-4]_H0.62_L0_Fab Heavy Chain
QVQLVESGGGVVQPGRSLRLSCAASGFTFSSYTMHWVRQAPGKGLEWVTFISYKGNNKYYADSVKGRFTISEDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3540 - protein, 118 aa, Artificial Sequence; identical to SEQ ID NO: 742
  Description of Artificial Sequence: Synthetic polypeptide
  VH of XENP019272

SEQ ID NO: 3541 - protein, 5 aa, Artificial Sequence
  Description of Artificial Sequence: Synthetic peptide
  XENP019272 vhCDR1
SYTMH

SEQ ID NO: 3542 - protein, 17 aa, Artificial Sequence
  Description of Artificial Sequence: Synthetic peptide
  XENP019272 vhCDR2
FISYKGNNKYYADSVKG

SEQ ID NO: 3543 - protein, 9 aa, Artificial Sequence
  Description of Artificial Sequence: Synthetic peptide
  XENP019272 vhCDR3
TGWLGPFDY

SEQ ID NO: 3544 - protein, 215 aa, Artificial Sequence; identical to SEQ ID NO: 2924
  Description of Artificial Sequence: Synthetic polypeptide
  XENP019272 [CTLA-4]_H0.62_L0_Fab Light Chain

SEQ ID NO: 3545 - protein, 108 aa, Artificial Sequence; identical to SEQ ID NO: 23
  Description of Artificial Sequence: Synthetic polypeptide
  VL of XENP019272

SEQ ID NO: 3546 - protein, 12 aa, Artificial Sequence
  Description of Artificial Sequence: Synthetic peptide
  XENP019272 vlCDR1
RASQSVGSSYLA

SEQ ID NO: 3547 - protein, 7 aa, Artificial Sequence
  Description of Artificial Sequence: Synthetic peptide
  XENP019272 vlCDR2
GAFSRAT

SEQ ID NO: 3548 - protein, 9 aa, Artificial Sequence
  Description of Artificial Sequence: Synthetic peptide
  XENP019272 vlCDR3
QQYGSSPWT

SEQ ID NO: 3549 - protein, 221 aa, Artificial Sequence
  Description of Artificial Sequence: Synthetic polypeptide
  XENP019273 [CTLA-4]_H0.63_L0_Fab Heavy Chain
QVQLVESGGGVVQPGRSLRLSCAASGFTFSSYTMHWVRQAPGKGLEWVTFISYQGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3550 - protein, 118 aa, Artificial Sequence; identical to SEQ ID NO: 751
  Description of Artificial Sequence: Synthetic polypeptide
  VH of XENP019273

SEQ ID NO: 3551 - protein, 5 aa, Artificial Sequence
  Description of Artificial Sequence: Synthetic peptide
  XENP019273 vhCDR1
SYTMH

SEQ ID NO: 3552 - protein, 17 aa, Artificial Sequence
  Description of Artificial Sequence: Synthetic peptide
  XENP019273 vhCDR2
FISYQGNNKYYADSVKG

SEQ ID NO: 3553 - protein, 9 aa, Artificial Sequence
  Description of Artificial Sequence: Synthetic peptide
  XENP019273 vhCDR3
TGWLGPFDY

SEQ ID NO: 3554 - protein, 215 aa, Artificial Sequence; identical to SEQ ID NO: 2924
  Description of Artificial Sequence: Synthetic polypeptide
  XENP019273 [CTLA-4]_H0.63_L0_Fab Light Chain

SEQ ID NO: 3555 - protein, 108 aa, Artificial Sequence; identical to SEQ ID NO: 23
  Description of Artificial Sequence: Synthetic polypeptide
  VL of XENP019273

SEQ ID NO: 3556 - protein, 12 aa, Artificial Sequence
  Description of Artificial Sequence: Synthetic peptide
  XENP019273 vlCDR1
RASQSVGSSYLA

SEQ ID NO: 3557 - protein, 7 aa, Artificial Sequence
  Description of Artificial Sequence: Synthetic peptide
  XENP019273 vlCDR2
GAFSRAT

SEQ ID NO: 3558 - protein, 9 aa, Artificial Sequence
  Description of Artificial Sequence: Synthetic peptide
  XENP019273 vlCDR3
QQYGSSPWT

SEQ ID NO: 3559 - protein, 221 aa, Artificial Sequence
  Description of Artificial Sequence: Synthetic polypeptide
  XENP019274 [CTLA-4]_H0.64_L0_Fab Heavy Chain
QVQLVESGGGVVQPGRSLRLSCAASGFTFSSYTMHWVRQAPGKGLEWVTFISYDKNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3560 - protein, 118 aa, Artificial Sequence; identical to SEQ ID NO: 760
  Description of Artificial Sequence: Synthetic polypeptide
  VH of XENP019274

SEQ ID NO: 3561 - protein, 5 aa, Artificial Sequence
  Description of Artificial Sequence: Synthetic peptide
  XENP019274 vhCDR1
SYTMH

SEQ ID NO: 3562 - protein, 17 aa, Artificial Sequence
  Description of Artificial Sequence: Synthetic peptide
  XENP019274 vhCDR2
FISYDKNNKYYADSVKG

SEQ ID NO: 3563 - protein, 9 aa, Artificial Sequence
  Description of Artificial Sequence: Synthetic peptide
  XENP019274 vhCDR3
TGWLGPFDY

SEQ ID NO: 3564 - protein, 215 aa, Artificial Sequence; identical to SEQ ID NO: 2924
  Description of Artificial Sequence: Synthetic polypeptide
  XENP019274 [CTLA-4]_H0.64_L0_Fab Light Chain

SEQ ID NO: 3565 - protein, 108 aa, Artificial Sequence; identical to SEQ ID NO: 23
  Description of Artificial Sequence: Synthetic polypeptide
  VL of XENP019274

SEQ ID NO: 3566 - protein, 12 aa, Artificial Sequence
  Description of Artificial Sequence: Synthetic peptide
  XENP019274 vlCDR1
RASQSVGSSYLA

SEQ ID NO: 3567 - protein, 7 aa, Artificial Sequence
  Description of Artificial Sequence: Synthetic peptide
  XENP019274 vlCDR2
GAFSRAT

SEQ ID NO: 3568 - protein, 9 aa, Artificial Sequence
  Description of Artificial Sequence: Synthetic peptide
  XENP019274 vlCDR3
QQYGSSPWT

SEQ ID NO: 3569 - protein, 221 aa, Artificial Sequence
  Description of Artificial Sequence: Synthetic polypeptide
  XENP019275 [CTLA-4]_H0.65_L0_Fab Heavy Chain
QVQLVESGGGVVQPGRSLRLSCAASGFTFSSYTMHWVRQAPGKGLEWVTFISYDKNNKYYADSVKGRFTISEDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3570 - protein, 118 aa, Artificial Sequence; identical to SEQ ID NO: 769
  Description of Artificial Sequence: Synthetic polypeptide
  VH of XENP019275

SEQ ID NO: 3571 - protein, 5 aa, Artificial Sequence
  Description of Artificial Sequence: Synthetic peptide
  XENP019275 vhCDR1
SYTMH

SEQ ID NO: 3572 - protein, 17 aa, Artificial Sequence
  Description of Artificial Sequence: Synthetic peptide
  XENP019275 vhCDR2
FISYDKNNKYYADSVKG

SEQ ID NO: 3573 - protein, 9 aa, Artificial Sequence
  Description of Artificial Sequence: Synthetic peptide
  XENP019275 vhCDR3
TGWLGPFDY

SEQ ID NO: 3574 - protein, 215 aa, Artificial Sequence; identical to SEQ ID NO: 2924
  Description of Artificial Sequence: Synthetic polypeptide
  XENP019275 [CTLA-4]_H0.65_L0_Fab Light Chain

SEQ ID NO: 3575 - protein, 108 aa, Artificial Sequence; identical to SEQ ID NO: 23
  Description of Artificial Sequence: Synthetic polypeptide
  VL of XENP019275

SEQ ID NO: 3576 - protein, 12 aa, Artificial Sequence
  Description of Artificial Sequence: Synthetic peptide
  XENP019275 vlCDR1
RASQSVGSSYLA

SEQ ID NO: 3577 - protein, 7 aa, Artificial Sequence
  Description of Artificial Sequence: Synthetic peptide
  XENP019275 vlCDR2
GAFSRAT

SEQ ID NO: 3578 - protein, 9 aa, Artificial Sequence
  Description of Artificial Sequence: Synthetic peptide
  XENP019275 vlCDR3
QQYGSSPWT

SEQ ID NO: 3579 - protein, 221 aa, Artificial Sequence
  Description of Artificial Sequence: Synthetic polypeptide
  XENP019276 [CTLA-4]_H0.66_L0_Fab Heavy Chain
QVQLVESGGGVVQPGRSLRLSCAASGFTFSSYTMHWVRQAPGKGLEWVTFISYDGDNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3580 - protein, 118 aa, Artificial Sequence; identical to SEQ ID NO: 778
  Description of Artificial Sequence: Synthetic polypeptide
  VH of XENP019276

SEQ ID NO: 3581 - protein, 5 aa, Artificial Sequence
  Description of Artificial Sequence: Synthetic peptide
  XENP019276 vhCDR1
SYTMH

SEQ ID NO: 3582 - protein, 17 aa, Artificial Sequence
  Description of Artificial Sequence: Synthetic peptide
  XENP019276 vhCDR2
FISYDGDNKYYADSVKG

SEQ ID NO: 3583 - protein, 9 aa, Artificial Sequence
  Description of Artificial Sequence: Synthetic peptide
  XENP019276 vhCDR3
TGWLGPFDY

SEQ ID NO: 3584 - protein, 215 aa, Artificial Sequence; identical to SEQ ID NO: 2924
  Description of Artificial Sequence: Synthetic polypeptide
  XENP019276 [CTLA-4]_H0.66_L0_Fab Light Chain

SEQ ID NO: 3585 - protein, 108 aa, Artificial Sequence; identical to SEQ ID NO: 23
  Description of Artificial Sequence: Synthetic polypeptide
  VL of XENP019276

SEQ ID NO: 3586 - protein, 12 aa, Artificial Sequence
  Description of Artificial Sequence: Synthetic peptide
  XENP019276 vlCDR1
RASQSVGSSYLA

SEQ ID NO: 3587 - protein, 7 aa, Artificial Sequence
  Description of Artificial Sequence: Synthetic peptide
  XENP019276 vlCDR2
GAFSRAT

SEQ ID NO: 3588 - protein, 9 aa, Artificial Sequence
  Description of Artificial Sequence: Synthetic peptide
  XENP019276 vlCDR3
QQYGSSPWT

SEQ ID NO: 3589 - protein, 221 aa, Artificial Sequence
  Description of Artificial Sequence: Synthetic polypeptide
  XENP019277 [CTLA-4]_H0.67_L0_Fab Heavy Chain
QVQLVESGGGVVQPGRSLRLSCAASGFTFSSYTMHWVRQAPGKGLEWVTFISYDGGNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3590 - protein, 118 aa, Artificial Sequence; identical to SEQ ID NO: 787
  Description of Artificial Sequence: Synthetic polypeptide
  VH of XENP019277

SEQ ID NO: 3591 - protein, 5 aa, Artificial Sequence
  Description of Artificial Sequence: Synthetic peptide
  XENP019277 vhCDR1
SYTMH

SEQ ID NO: 3592 - protein, 17 aa, Artificial Sequence
  Description of Artificial Sequence: Synthetic peptide
  XENP019277 vhCDR2
FISYDGGNKYYADSVKG

SEQ ID NO: 3593 - protein, 9 aa, Artificial Sequence
  Description of Artificial Sequence: Synthetic peptide
  XENP019277 vhCDR3
TGWLGPFDY

SEQ ID NO: 3594 - protein, 215 aa, Artificial Sequence; identical to SEQ ID NO: 2924
  Description of Artificial Sequence: Synthetic polypeptide
  XENP019277 [CTLA-4]_H0.67_L0_Fab Light Chain

SEQ ID NO: 3595 - protein, 108 aa, Artificial Sequence; identical to SEQ ID NO: 23
  Description of Artificial Sequence: Synthetic polypeptide
  VL of XENP019277

SEQ ID NO: 3596 - protein, 12 aa, Artificial Sequence
  Description of Artificial Sequence: Synthetic peptide
  XENP019277 vlCDR1
RASQSVGSSYLA

SEQ ID NO: 3597 - protein, 7 aa, Artificial Sequence
  Description of Artificial Sequence: Synthetic peptide
  XENP019277 vlCDR2
GAFSRAT

SEQ ID NO: 3598 - protein, 9 aa, Artificial Sequence
  Description of Artificial Sequence: Synthetic peptide
  XENP019277 vlCDR3
QQYGSSPWT

SEQ ID NO: 3599 - protein, 221 aa, Artificial Sequence
  Description of Artificial Sequence: Synthetic polypeptide
  XENP019278 [CTLA-4]_H0.68_L0_Fab Heavy Chain
QVQLVESGGGVVQPGRSLRLSCAASGFTFSSYTMHWVRQAPGKGLEWVTFISYDGHNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3600 - protein, 118 aa, Artificial Sequence; identical to SEQ ID NO: 796
  Description of Artificial Sequence: Synthetic polypeptide
  VH of XENP019278

SEQ ID NO: 3601 - protein, 5 aa, Artificial Sequence
  Description of Artificial Sequence: Synthetic peptide
  XENP019278 vhCDR1
SYTMH

SEQ ID NO: 3602 - protein, 17 aa, Artificial Sequence
  Description of Artificial Sequence: Synthetic peptide
  XENP019278 vhCDR2
FISYDGHNKYYADSVKG

SEQ ID NO: 3603 - protein, 9 aa, Artificial Sequence
  Description of Artificial Sequence: Synthetic peptide
  XENP019278 vhCDR3
TGWLGPFDY

SEQ ID NO: 3604 - protein, 215 aa, Artificial Sequence; identical to SEQ ID NO: 2924
  Description of Artificial Sequence: Synthetic polypeptide
  XENP019278 [CTLA-4]_H0.68_L0_Fab Light Chain

SEQ ID NO: 3605 - protein, 108 aa, Artificial Sequence; identical to SEQ ID NO: 23
  Description of Artificial Sequence: Synthetic polypeptide
  VL of XENP019278

SEQ ID NO: 3606 - protein, 12 aa, Artificial Sequence
  Description of Artificial Sequence: Synthetic peptide
  XENP019278 vlCDR1
RASQSVGSSYLA

SEQ ID NO: 3607 - protein, 7 aa, Artificial Sequence
  Description of Artificial Sequence: Synthetic peptide
  XENP019278 vlCDR2
GAFSRAT

SEQ ID NO: 3608 - protein, 9 aa, Artificial Sequence
  Description of Artificial Sequence: Synthetic peptide
  XENP019278 vlCDR3
QQYGSSPWT

SEQ ID NO: 3609 - protein, 221 aa, Artificial Sequence
  Description of Artificial Sequence: Synthetic polypeptide
  XENP019279 [CTLA-4]_H0.69_L0_Fab Heavy Chain
QVQLVESGGGVVQPGRSLRLSCAASGFTFSSYTMHWVRQAPGKGLEWVTFISYDGQNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3610 - protein, 118 aa, Artificial Sequence; identical to SEQ ID NO: 805
  Description of Artificial Sequence: Synthetic polypeptide
  VH of XENP019279

SEQ ID NO: 3611 - protein, 5 aa, Artificial Sequence
  Description of Artificial Sequence: Synthetic peptide
  XENP019279 vhCDR1
SYTMH

SEQ ID NO: 3612 - protein, 17 aa, Artificial Sequence
  Description of Artificial Sequence: Synthetic peptide
  XENP019279 vhCDR2
FISYDGQNKYYADSVKG

SEQ ID NO: 3613 - protein, 9 aa, Artificial Sequence
  Description of Artificial Sequence: Synthetic peptide
  XENP019279 vhCDR3
TGWLGPFDY

SEQ ID NO: 3614 - protein, 215 aa, Artificial Sequence; identical to SEQ ID NO: 2924
  Description of Artificial Sequence: Synthetic polypeptide
  XENP019279 [CTLA-4]_H0.69_L0_Fab Light Chain

SEQ ID NO: 3615 - protein, 108 aa, Artificial Sequence; identical to SEQ ID NO: 23
  Description of Artificial Sequence: Synthetic polypeptide
  VL of XENP019279

SEQ ID NO: 3616 - protein, 12 aa, Artificial Sequence
  Description of Artificial Sequence: Synthetic peptide
  XENP019279 vlCDR1
RASQSVGSSYLA

SEQ ID NO: 3617 - protein, 7 aa, Artificial Sequence
  Description of Artificial Sequence: Synthetic peptide
  XENP019279 vlCDR2
GAFSRAT

SEQ ID NO: 3618 - protein, 9 aa, Artificial Sequence
  Description of Artificial Sequence: Synthetic peptide
  XENP019279 vlCDR3
QQYGSSPWT

SEQ ID NO: 3619 - protein, 221 aa, Artificial Sequence
  Description of Artificial Sequence: Synthetic polypeptide
  XENP019280 [CTLA-4]_H0.70_L0_Fab Heavy Chain
QVQLVESGGGVVQPGRSLRLSCAASGFTFSSYTMHWVRQAPGKGLEWVTFISYDGSNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3620 - protein, 118 aa, Artificial Sequence; identical to SEQ ID NO: 814
  Description of Artificial Sequence: Synthetic polypeptide
  VH of XENP019280

SEQ ID NO: 3621 - protein, 5 aa, Artificial Sequence
  Description of Artificial Sequence: Synthetic peptide
  XENP019280 vhCDR1
SYTMH

SEQ ID NO: 3622 - protein, 17 aa, Artificial Sequence
  Description of Artificial Sequence: Synthetic peptide
  XENP019280 vhCDR2
FISYDGSNKYYADSVKG

SEQ ID NO: 3623 - protein, 9 aa, Artificial Sequence
  Description of Artificial Sequence: Synthetic peptide
  XENP019280 vhCDR3
TGWLGPFDY

SEQ ID NO: 3624 - protein, 215 aa, Artificial Sequence; identical to SEQ ID NO: 2924
  Description of Artificial Sequence: Synthetic polypeptide
  XENP019280 [CTLA-4]_H0.70_L0_Fab Light Chain

SEQ ID NO: 3625 - protein, 108 aa, Artificial Sequence; identical to SEQ ID NO: 23
  Description of Artificial Sequence: Synthetic polypeptide
  VL of XENP019280

SEQ ID NO: 3626 - protein, 12 aa, Artificial Sequence
  Description of Artificial Sequence: Synthetic peptide
  XENP019280 vlCDR1
RASQSVGSSYLA

SEQ ID NO: 3627 - protein, 7 aa, Artificial Sequence
  Description of Artificial Sequence: Synthetic peptide
  XENP019280 vlCDR2
GAFSRAT

SEQ ID NO: 3628 - protein, 9 aa, Artificial Sequence
  Description of Artificial Sequence: Synthetic peptide
  XENP019280 vlCDR3
QQYGSSPWT

SEQ ID NO: 3629 - protein, 221 aa, Artificial Sequence
  Description of Artificial Sequence: Synthetic polypeptide
  XENP019281 [CTLA-4]_H0.71_L0_Fab Heavy Chain
QVQLVESGGGVVQPGRSLRLSCAASGFTFSSYTMHWVRQAPGKGLEWVTFISYDGNDKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3630 - protein, 118 aa, Artificial Sequence; identical to SEQ ID NO: 823
  Description of Artificial Sequence: Synthetic polypeptide
  VH of XENP019281

SEQ ID NO: 3631 - protein, 5 aa, Artificial Sequence
  Description of Artificial Sequence: Synthetic peptide
  XENP019281 vhCDR1
SYTMH

SEQ ID NO: 3632 - protein, 17 aa, Artificial Sequence
  Description of Artificial Sequence: Synthetic peptide
  XENP019281 vhCDR2
FISYDGNDKYYADSVKG

SEQ ID NO: 3633 - protein, 9 aa, Artificial Sequence
  Description of Artificial Sequence: Synthetic peptide
  XENP019281 vhCDR3
TGWLGPFDY

SEQ ID NO: 3634 - protein, 215 aa, Artificial Sequence; identical to SEQ ID NO: 2924
  Description of Artificial Sequence: Synthetic polypeptide
  XENP019281 [CTLA-4]_H0.71_L0_Fab Light Chain

SEQ ID NO: 3635 - protein, 108 aa, Artificial Sequence; identical to SEQ ID NO: 23
  Description of Artificial Sequence: Synthetic polypeptide
  VL of XENP019281

SEQ ID NO: 3636 - protein, 12 aa, Artificial Sequence
  Description of Artificial Sequence: Synthetic peptide
  XENP019281 vlCDR1
RASQSVGSSYLA

SEQ ID NO: 3637 - protein, 7 aa, Artificial Sequence
  Description of Artificial Sequence: Synthetic peptide
  XENP019281 vlCDR2
GAFSRAT

SEQ ID NO: 3638 - protein, 9 aa, Artificial Sequence
  Description of Artificial Sequence: Synthetic peptide
  XENP019281 vlCDR3
QQYGSSPWT

SEQ ID NO: 3639 - protein, 221 aa, Artificial Sequence
  Description of Artificial Sequence: Synthetic polypeptide
  XENP019282 [CTLA-4]_H0.72_L0_Fab Heavy Chain
QVQLVESGGGVVQPGRSLRLSCAASGFTFSSYTMHWVRQAPGKGLEWVTFISYDGNEKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3640 - protein, 118 aa, Artificial Sequence; identical to SEQ ID NO: 832
  Description of Artificial Sequence: Synthetic polypeptide
  VH of XENP019282

SEQ ID NO: 3641 - protein, 5 aa, Artificial Sequence
  Description of Artificial Sequence: Synthetic peptide
  XENP019282 vhCDR1
SYTMH

SEQ ID NO: 3642 - protein, 17 aa, Artificial Sequence
  Description of Artificial Sequence: Synthetic peptide
  XENP019282 vhCDR2
FISYDGNEKYYADSVKG

SEQ ID NO: 3643 - protein, 9 aa, Artificial Sequence
  Description of Artificial Sequence: Synthetic peptide
  XENP019282 vhCDR3
TGWLGPFDY

SEQ ID NO: 3644 - protein, 215 aa, Artificial Sequence; identical to SEQ ID NO: 2924
  Description of Artificial Sequence: Synthetic polypeptide
  XENP019282 [CTLA-4]_H0.72_L0_Fab Light Chain

SEQ ID NO: 3645 - protein, 108 aa, Artificial Sequence; identical to SEQ ID NO: 23
  Description of Artificial Sequence: Synthetic polypeptide
  VL of XENP019282

SEQ ID NO: 3646 - protein, 12 aa, Artificial Sequence
  Description of Artificial Sequence: Synthetic peptide
  XENP019282 vlCDR1
RASQSVGSSYLA

SEQ ID NO: 3647 - protein, 7 aa, Artificial Sequence
  Description of Artificial Sequence: Synthetic peptide
  XENP019282 vlCDR2
GAFSRAT

SEQ ID NO: 3648 - protein, 9 aa, Artificial Sequence
  Description of Artificial Sequence: Synthetic peptide
  XENP019282 vlCDR3
QQYGSSPWT

SEQ ID NO: 3649 - protein, 221 aa, Artificial Sequence
  Description of Artificial Sequence: Synthetic polypeptide
  XENP019283 [CTLA-4]_H0.73_L0_Fab Heavy Chain
QVQLVESGGGVVQPGRSLRLSCAASGFTFSSYTMHWVRQAPGKGLEWVTFISYDGNHKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3650 - protein, 118 aa, Artificial Sequence; identical to SEQ ID NO: 841
  Description of Artificial Sequence: Synthetic polypeptide
  VH of XENP019283

SEQ ID NO: 3651 - protein, 5 aa, Artificial Sequence
  Description of Artificial Sequence: Synthetic peptide
  XENP019283 vhCDR1
SYTMH

SEQ ID NO: 3652 - protein, 17 aa, Artificial Sequence
  Description of Artificial Sequence: Synthetic peptide
  XENP019283 vhCDR2
FISYDGNHKYYADSVKG

SEQ ID NO: 3653 - protein, 9 aa, Artificial Sequence
  Description of Artificial Sequence: Synthetic peptide
  XENP019283 vhCDR3
TGWLGPFDY

SEQ ID NO: 3654 - protein, 215 aa, Artificial Sequence; identical to SEQ ID NO: 2924
  Description of Artificial Sequence: Synthetic polypeptide
  XENP019283 [CTLA-4]_H0.73_L0_Fab Light Chain

SEQ ID NO: 3655 - protein, 108 aa, Artificial Sequence; identical to SEQ ID NO: 23
  Description of Artificial Sequence: Synthetic polypeptide
  VL of XENP019283

SEQ ID NO: 3656 - protein, 12 aa, Artificial Sequence
  Description of Artificial Sequence: Synthetic peptide
  XENP019283 vlCDR1
RASQSVGSSYLA

SEQ ID NO: 3657 - protein, 7 aa, Artificial Sequence
  Description of Artificial Sequence: Synthetic peptide
  XENP019283 vlCDR2
GAFSRAT

SEQ ID NO: 3658 - protein, 9 aa, Artificial Sequence
  Description of Artificial Sequence: Synthetic peptide
  XENP019283 vlCDR3
QQYGSSPWT

SEQ ID NO: 3659 - protein, 221 aa, Artificial Sequence
  Description of Artificial Sequence: Synthetic polypeptide
  XENP019284 [CTLA-4]_H0.74_L0_Fab Heavy Chain
QVQLVESGGGVVQPGRSLRLSCAASGFTFSSYTMHWVRQAPGKGLEWVTFISYDGNSKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3660 - protein, 118 aa, Artificial Sequence; identical to SEQ ID NO: 850
  Description of Artificial Sequence: Synthetic polypeptide
  VH of XENP019284

SEQ ID NO: 3661 - protein, 5 aa, Artificial Sequence
  Description of Artificial Sequence: Synthetic peptide
  XENP019284 vhCDR1
SYTMH

SEQ ID NO: 3662 - protein, 17 aa, Artificial Sequence
  Description of Artificial Sequence: Synthetic peptide
  XENP019284 vhCDR2
FISYDGNSKYYADSVKG

SEQ ID NO: 3663 - protein, 9 aa, Artificial Sequence
  Description of Artificial Sequence: Synthetic peptide
  XENP019284 vhCDR3
TGWLGPFDY

SEQ ID NO: 3664 - protein, 215 aa, Artificial Sequence; identical to SEQ ID NO: 2924
  Description of Artificial Sequence: Synthetic polypeptide
  XENP019284 [CTLA-4]_H0.74_L0_Fab Light Chain

SEQ ID NO: 3665 - protein, 108 aa, Artificial Sequence; identical to SEQ ID NO: 23
  Description of Artificial Sequence: Synthetic polypeptide
  VL of XENP019284

SEQ ID NO: 3666 - protein, 12 aa, Artificial Sequence
  Description of Artificial Sequence: Synthetic peptide
  XENP019284 vlCDR1
RASQSVGSSYLA

SEQ ID NO: 3667 - protein, 7 aa, Artificial Sequence
  Description of Artificial Sequence: Synthetic peptide
  XENP019284 vlCDR2
GAFSRAT

SEQ ID NO: 3668 - protein, 9 aa, Artificial Sequence
  Description of Artificial Sequence: Synthetic peptide
  XENP019284 vlCDR3
QQYGSSPWT

SEQ ID NO: 3669 - protein, 221 aa, Artificial Sequence
  Description of Artificial Sequence: Synthetic polypeptide
  XENP019285 [CTLA-4]_H0.75_L0_Fab Heavy Chain
QVQLVESGGGVVQPGRSLRLSCAASGFTFSSYTMHWVRQAPGKGLEWVTFISYDGNTKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3670 - protein, 118 aa, Artificial Sequence; identical to SEQ ID NO: 859
  Description of Artificial Sequence: Synthetic polypeptide
  VH of XENP019285

SEQ ID NO: 3671 - protein, 5 aa, Artificial Sequence
  Description of Artificial Sequence: Synthetic peptide
  XENP019285 vhCDR1
SYTMH

SEQ ID NO: 3672 - protein, 17 aa, Artificial Sequence
  Description of Artificial Sequence: Synthetic peptide
  XENP019285 vhCDR2
FISYDGNTKYYADSVKG

SEQ ID NO: 3673 - protein, 9 aa, Artificial Sequence
  Description of Artificial Sequence: Synthetic peptide
  XENP019285 vhCDR3
TGWLGPFDY

SEQ ID NO: 3674 - protein, 215 aa, Artificial Sequence; identical to SEQ ID NO: 2924
  Description of Artificial Sequence: Synthetic polypeptide
  XENP019285 [CTLA-4]_H0.75_L0_Fab Light Chain

SEQ ID NO: 3675 - protein, 108 aa, Artificial Sequence; identical to SEQ ID NO: 23
  Description of Artificial Sequence: Synthetic polypeptide
  VL of XENP019285

SEQ ID NO: 3676 - protein, 12 aa, Artificial Sequence
  Description of Artificial Sequence: Synthetic peptide
  XENP019285 vlCDR1
RASQSVGSSYLA

SEQ ID NO: 3677 - protein, 7 aa, Artificial Sequence
  Description of Artificial Sequence: Synthetic peptide
  XENP019285 vlCDR2
GAFSRAT

SEQ ID NO: 3678 - protein, 9 aa, Artificial Sequence
  Description of Artificial Sequence: Synthetic peptide
  XENP019285 vlCDR3
QQYGSSPWT

SEQ ID NO: 3679 - protein, 221 aa, Artificial Sequence
  Description of Artificial Sequence: Synthetic polypeptide
  XENP019286 [CTLA-4]_H0.76_L0_Fab Heavy Chain
QVQLVESGGGVVQPGRSLRLSCAASGFTFSSYTMHWVRQAPGKGLEWVTFISYDGNQKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3680 - protein, 118 aa, Artificial Sequence; identical to SEQ ID NO: 868
  Description of Artificial Sequence: Synthetic polypeptide
  VH of XENP019286

SEQ ID NO: 3681 - protein, 5 aa, Artificial Sequence
  Description of Artificial Sequence: Synthetic peptide
  XENP019286 vhCDR1
SYTMH

SEQ ID NO: 3682 - protein, 17 aa, Artificial Sequence
  Description of Artificial Sequence: Synthetic peptide
  XENP019286 vhCDR2
FISYDGNQKYYADSVKG

SEQ ID NO: 3683 - protein, 9 aa, Artificial Sequence
  Description of Artificial Sequence: Synthetic peptide
  XENP019286 vhCDR3
TGWLGPFDY

SEQ ID NO: 3684 - protein, 215 aa, Artificial Sequence; identical to SEQ ID NO: 2924
  Description of Artificial Sequence: Synthetic polypeptide
  XENP019286 [CTLA-4]_H0.76_L0_Fab Light Chain

SEQ ID NO: 3685 - protein, 108 aa, Artificial Sequence; identical to SEQ ID NO: 23
  Description of Artificial Sequence: Synthetic polypeptide
  VL of XENP019286

SEQ ID NO: 3686 - protein, 12 aa, Artificial Sequence
  Description of Artificial Sequence: Synthetic peptide
  XENP019286 vlCDR1
RASQSVGSSYLA

SEQ ID NO: 3687 - protein, 7 aa, Artificial Sequence
  Description of Artificial Sequence: Synthetic peptide
  XENP019286 vlCDR2
GAFSRAT

SEQ ID NO: 3688 - protein, 9 aa, Artificial Sequence
  Description of Artificial Sequence: Synthetic peptide
  XENP019286 vlCDR3
QQYGSSPWT

SEQ ID NO: 3689 - protein, 221 aa, Artificial Sequence
  Description of Artificial Sequence: Synthetic polypeptide
  XENP019287 [CTLA-4]_H0.77_L0_Fab Heavy Chain
QVQLVESGGGVVQPGRSLRLSCAASGFTFSSYTMHWVRQAPGKGLEWVTFISYDGNNIYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3690 - protein, 118 aa, Artificial Sequence; identical to SEQ ID NO: 877
  Description of Artificial Sequence: Synthetic polypeptide
  VH of XENP019287

SEQ ID NO: 3691 - protein, 5 aa, Artificial Sequence
  Description of Artificial Sequence: Synthetic peptide
  XENP019287 vhCDR1
SYTMH

SEQ ID NO: 3692 - protein, 17 aa, Artificial Sequence
  Description of Artificial Sequence: Synthetic peptide
  XENP019287 vhCDR2
FISYDGNNIYYADSVKG

SEQ ID NO: 3693 - protein, 9 aa, Artificial Sequence
  Description of Artificial Sequence: Synthetic peptide
  XENP019287 vhCDR3
TGWLGPFDY

SEQ ID NO: 3694 - protein, 215 aa, Artificial Sequence; identical to SEQ ID NO: 2924
  Description of Artificial Sequence: Synthetic polypeptide
  XENP019287 [CTLA-4]_H0.77_L0_Fab Light Chain

SEQ ID NO: 3695 - protein, 108 aa, Artificial Sequence; identical to SEQ ID NO: 23
  Description of Artificial Sequence: Synthetic polypeptide
  VL of XENP019287

SEQ ID NO: 3696 - protein, 12 aa, Artificial Sequence
  Description of Artificial Sequence: Synthetic peptide
  XENP019287 vlCDR1
RASQSVGSSYLA

SEQ ID NO: 3697 - protein, 7 aa, Artificial Sequence
  Description of Artificial Sequence: Synthetic peptide
  XENP019287 vlCDR2
GAFSRAT

SEQ ID NO: 3698 - protein, 9 aa, Artificial Sequence
  Description of Artificial Sequence: Synthetic peptide
  XENP019287 vlCDR3
QQYGSSPWT

SEQ ID NO: 3699 - protein, 221 aa, Artificial Sequence
  Description of Artificial Sequence: Synthetic polypeptide
  XENP019288 [CTLA-4]_H0.78_L0_Fab Heavy Chain
QVQLVESGGGVVQPGRSLRLSCAASGFTFSSYTMHWVRQAPGKGLEWVTFISYDGNNTYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3700 - protein, 118 aa, Artificial Sequence; identical to SEQ ID NO: 886
  Description of Artificial Sequence: Synthetic polypeptide
  VH of XENP019288

SEQ ID NO: 3701 - protein, 5 aa, Artificial Sequence
  Description of Artificial Sequence: Synthetic peptide
  XENP019288 vhCDR1
SYTMH

SEQ ID NO: 3702 - protein, 17 aa, Artificial Sequence
  Description of Artificial Sequence: Synthetic peptide
  XENP019288 vhCDR2
FISYDGNNTYYADSVKG

SEQ ID NO: 3703 - protein, 9 aa, Artificial Sequence
  Description of Artificial Sequence: Synthetic peptide
  XENP019288 vhCDR3
TGWLGPFDY

SEQ ID NO: 3704 - protein, 215 aa, Artificial Sequence; identical to SEQ ID NO: 2924
  Description of Artificial Sequence: Synthetic polypeptide
  XENP019288 [CTLA-4]_H0.78_L0_Fab Light Chain

SEQ ID NO: 3705 - protein, 108 aa, Artificial Sequence; identical to SEQ ID NO: 23
  Description of Artificial Sequence: Synthetic polypeptide
  VL of XENP019288

SEQ ID NO: 3706 - protein, 12 aa, Artificial Sequence
  Description of Artificial Sequence: Synthetic peptide
  XENP019288 vlCDR1
RASQSVGSSYLA

SEQ ID NO: 3707 - protein, 7 aa, Artificial Sequence
  Description of Artificial Sequence: Synthetic peptide
  XENP019288 vlCDR2
GAFSRAT

SEQ ID NO: 3708 - protein, 9 aa, Artificial Sequence
  Description of Artificial Sequence: Synthetic peptide
  XENP019288 vlCDR3
QQYGSSPWT

SEQ ID NO: 3709 - protein, 221 aa, Artificial Sequence
  Description of Artificial Sequence: Synthetic polypeptide
  XENP019289 [CTLA-4]_H0.79_L0_Fab Heavy Chain
QVQLVESGGGVVQPGRSLRLSCAASGFTFSSYTMHWVRQAPGKGLEWVTFISYDGNNKAYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3710 - protein, 118 aa, Artificial Sequence; identical to SEQ ID NO: 895
  Description of Artificial Sequence: Synthetic polypeptide
  VH of XENP019289

SEQ ID NO: 3711 - protein, 5 aa, Artificial Sequence
  Description of Artificial Sequence: Synthetic peptide
  XENP019289 vhCDR1
SYTMH

SEQ ID NO: 3712 - protein, 17 aa, Artificial Sequence
  Description of Artificial Sequence: Synthetic peptide
  XENP019289 vhCDR2
FISYDGNNKAYADSVKG

SEQ ID NO: 3713 - protein, 9 aa, Artificial Sequence
  Description of Artificial Sequence: Synthetic peptide
  XENP019289 vhCDR3
TGWLGPFDY

SEQ ID NO: 3714 - protein, 215 aa, Artificial Sequence; identical to SEQ ID NO: 2924
  Description of Artificial Sequence: Synthetic polypeptide
  XENP019289 [CTLA-4]_H0.79_L0_Fab Light Chain

SEQ ID NO: 3715 - protein, 108 aa, Artificial Sequence; identical to SEQ ID NO: 23
  Description of Artificial Sequence: Synthetic polypeptide
  VL of XENP019289

SEQ ID NO: 3716 - protein, 12 aa, Artificial Sequence
  Description of Artificial Sequence: Synthetic peptide
  XENP019289 vlCDR1
RASQSVGSSYLA

SEQ ID NO: 3717 - protein, 7 aa, Artificial Sequence
  Description of Artificial Sequence: Synthetic peptide
  XENP019289 vlCDR2
GAFSRAT

SEQ ID NO: 3718 - protein, 9 aa, Artificial Sequence
  Description of Artificial Sequence: Synthetic peptide
  XENP019289 vlCDR3
QQYGSSPWT

SEQ ID NO: 3719 - protein, 221 aa, Artificial Sequence
  Description of Artificial Sequence: Synthetic polypeptide
  XENP019290 [CTLA-4]_H0.80_L0_Fab Heavy Chain
QVQLVESGGGVVQPGRSLRLSCAASGFTFSSYTMHWVRQAPGKGLEWVTFISYDGNNKYYAASVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3720 - protein, 118 aa, Artificial Sequence; identical to SEQ ID NO: 904
  Description of Artificial Sequence: Synthetic polypeptide
  VH of XENP019290

SEQ ID NO: 3721 - protein, 5 aa, Artificial Sequence
  Description of Artificial Sequence: Synthetic peptide
  XENP019290 vhCDR1
SYTMH

SEQ ID NO: 3722 - protein, 17 aa, Artificial Sequence
  Description of Artificial Sequence: Synthetic peptide
  XENP019290 vhCDR2
FISYDGNNKYYAASVKG

SEQ ID NO: 3723 - protein, 9 aa, Artificial Sequence
  Description of Artificial Sequence: Synthetic peptide
  XENP019290 vhCDR3
TGWLGPFDY

SEQ ID NO: 3724 - protein, 215 aa, Artificial Sequence; identical to SEQ ID NO: 2924
  Description of Artificial Sequence: Synthetic polypeptide
  XENP019290 [CTLA-4]_H0.80_L0_Fab Light Chain

SEQ ID NO: 3725 - protein, 108 aa, Artificial Sequence; identical to SEQ ID NO: 23
  Description of Artificial Sequence: Synthetic polypeptide
  VL of XENP019290

SEQ ID NO: 3726 - protein, 12 aa, Artificial Sequence
  Description of Artificial Sequence: Synthetic peptide
  XENP019290 vlCDR1
RASQSVGSSYLA

SEQ ID NO: 3727 - protein, 7 aa, Artificial Sequence
  Description of Artificial Sequence: Synthetic peptide
  XENP019290 vlCDR2
GAFSRAT

SEQ ID NO: 3728 - protein, 9 aa, Artificial Sequence
  Description of Artificial Sequence: Synthetic peptide
  XENP019290 vlCDR3
QQYGSSPWT

SEQ ID NO: 3729 - protein, 221 aa, Artificial Sequence
  Description of Artificial Sequence: Synthetic polypeptide
  XENP019291 [CTLA-4]_H0.81_L0_Fab Heavy Chain
QVQLVESGGGVVQPGRSLRLSCAASGFTFSSYTMHWVRQAPGKGLEWVTFISYDGNNKYYAKSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3730 - protein, 118 aa, Artificial Sequence; identical to SEQ ID NO: 913
  Description of Artificial Sequence: Synthetic polypeptide
  VH of XENP019291

SEQ ID NO: 3731 - protein, 5 aa, Artificial Sequence
  Description of Artificial Sequence: Synthetic peptide
  XENP019291 vhCDR1
SYTMH

SEQ ID NO: 3732 - protein, 17 aa, Artificial Sequence
  Description of Artificial Sequence: Synthetic peptide
  XENP019291 vhCDR2
FISYDGNNKYYAKSVKG

SEQ ID NO: 3733 - protein, 9 aa, Artificial Sequence
  Description of Artificial Sequence: Synthetic peptide
  XENP019291 vhCDR3
TGWLGPFDY

SEQ ID NO: 3734 - protein, 215 aa, Artificial Sequence; identical to SEQ ID NO: 2924
  Description of Artificial Sequence: Synthetic polypeptide
  XENP019291 [CTLA-4]_H0.81_L0_Fab Light Chain

SEQ ID NO: 3735 - protein, 108 aa, Artificial Sequence; identical to SEQ ID NO: 23
  Description of Artificial Sequence: Synthetic polypeptide
  VL of XENP019291

SEQ ID NO: 3736 - protein, 12 aa, Artificial Sequence
  Description of Artificial Sequence: Synthetic peptide
  XENP019291 vlCDR1
RASQSVGSSYLA

SEQ ID NO: 3737 - protein, 7 aa, Artificial Sequence
  Description of Artificial Sequence: Synthetic peptide
  XENP019291 vlCDR2
GAFSRAT

SEQ ID NO: 3738 - protein, 9 aa, Artificial Sequence
  Description of Artificial Sequence: Synthetic peptide
  XENP019291 vlCDR3
QQYGSSPWT

SEQ ID NO: 3739 - protein, 221 aa, Artificial Sequence
  Description of Artificial Sequence: Synthetic polypeptide
  XENP019292 [CTLA-4]_H0.82_L0_Fab Heavy Chain
QVQLVESGGGVVQPGRSLRLSCAASGFTFSSYTMHWVRQAPGKGLEWVTFISYDGNNKYYADSVKDRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3740 - protein, 118 aa, Artificial Sequence; identical to SEQ ID NO: 922
  Description of Artificial Sequence: Synthetic polypeptide
  VH of XENP019292

SEQ ID NO: 3741 - protein, 5 aa, Artificial Sequence
  Description of Artificial Sequence: Synthetic peptide
  XENP019292 vhCDR1
SYTMH

SEQ ID NO: 3742 - protein, 17 aa, Artificial Sequence
  Description of Artificial Sequence: Synthetic peptide
  XENP019292 vhCDR2
FISYDGNNKYYADSVKD

SEQ ID NO: 3743 - protein, 9 aa, Artificial Sequence
  Description of Artificial Sequence: Synthetic peptide
  XENP019292 vhCDR3
TGWLGPFDY

SEQ ID NO: 3744 - protein, 215 aa, Artificial Sequence; identical to SEQ ID NO: 2924
  Description of Artificial Sequence: Synthetic polypeptide
  XENP019292 [CTLA-4]_H0.82_L0_Fab Light Chain

SEQ ID NO: 3745 - protein, 108 aa, Artificial Sequence; identical to SEQ ID NO: 23
  Description of Artificial Sequence: Synthetic polypeptide
  VL of XENP019292

SEQ ID NO: 3746 - protein, 12 aa, Artificial Sequence
  Description of Artificial Sequence: Synthetic peptide
  XENP019292 vlCDR1
RASQSVGSSYLA

SEQ ID NO: 3747 - protein, 7 aa, Artificial Sequence
  Description of Artificial Sequence: Synthetic peptide
  XENP019292 vlCDR2
GAFSRAT

SEQ ID NO: 3748 - protein, 9 aa, Artificial Sequence
  Description of Artificial Sequence: Synthetic peptide
  XENP019292 vlCDR3
QQYGSSPWT

SEQ ID NO: 3749 - protein, 221 aa, Artificial Sequence
  Description of Artificial Sequence: Synthetic polypeptide
  XENP019293 [CTLA-4]_H0.83_L0_Fab Heavy Chain
QVQLVESGGGVVQPGRSLRLSCAASGFTFSSYTMHWVRQAPGKGLEWVTFISYDGNNKYYADSVKERFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3750 - protein, 118 aa, Artificial Sequence; identical to SEQ ID NO: 931
  Description of Artificial Sequence: Synthetic polypeptide
  VH of XENP019293

SEQ ID NO: 3751 - protein, 5 aa, Artificial Sequence
  Description of Artificial Sequence: Synthetic peptide
  XENP019293 vhCDR1
SYTMH

SEQ ID NO: 3752 - protein, 17 aa, Artificial Sequence
  Description of Artificial Sequence: Synthetic peptide
  XENP019293 vhCDR2
FISYDGNNKYYADSVKE

SEQ ID NO: 3753 - protein, 9 aa, Artificial Sequence
  Description of Artificial Sequence: Synthetic peptide
  XENP019293 vhCDR3
TGWLGPFDY

SEQ ID NO: 3754 - protein, 215 aa, Artificial Sequence; identical to SEQ ID NO: 2924
  Description of Artificial Sequence: Synthetic polypeptide
  XENP019293 [CTLA-4]_H0.83_L0_Fab Light Chain

SEQ ID NO: 3755 - protein, 108 aa, Artificial Sequence; identical to SEQ ID NO: 23
  Description of Artificial Sequence: Synthetic polypeptide
  VL of XENP019293

SEQ ID NO: 3756 - protein, 12 aa, Artificial Sequence
  Description of Artificial Sequence: Synthetic peptide
  XENP019293 vlCDR1
RASQSVGSSYLA

SEQ ID NO: 3757 - protein, 7 aa, Artificial Sequence
  Description of Artificial Sequence: Synthetic peptide
  XENP019293 vlCDR2
GAFSRAT

SEQ ID NO: 3758 - protein, 9 aa, Artificial Sequence
  Description of Artificial Sequence: Synthetic peptide
  XENP019293 vlCDR3
QQYGSSPWT

SEQ ID NO: 3759 - protein, 221 aa, Artificial Sequence
  Description of Artificial Sequence: Synthetic polypeptide
  XENP019294 [CTLA-4]_H0.84_L0_Fab Heavy Chain
QVQLVESGGGVVQPGRSLRLSCAASGFTFSSYTMHWVRQAPGKGLEWVTFISYDGNNKYYADSVKGQFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3760 - protein, 118 aa, Artificial Sequence; identical to SEQ ID NO: 940
  Description of Artificial Sequence: Synthetic polypeptide
  VH of XENP019294

SEQ ID NO: 3761 - protein, 5 aa, Artificial Sequence
  Description of Artificial Sequence: Synthetic peptide
  XENP019294 vhCDR1
SYTMH

SEQ ID NO: 3762 - protein, 17 aa, Artificial Sequence
  Description of Artificial Sequence: Synthetic peptide
  XENP019294 vhCDR2
FISYDGNNKYYADSVKG

SEQ ID NO: 3763 - protein, 9 aa, Artificial Sequence
  Description of Artificial Sequence: Synthetic peptide
  XENP019294 vhCDR3
TGWLGPFDY

SEQ ID NO: 3764 - protein, 215 aa, Artificial Sequence; identical to SEQ ID NO: 2924
  Description of Artificial Sequence: Synthetic polypeptide
  XENP019294 [CTLA-4]_H0.84_L0_Fab Light Chain

SEQ ID NO: 3765 - protein, 108 aa, Artificial Sequence; identical to SEQ ID NO: 23
  Description of Artificial Sequence: Synthetic polypeptide
  VL of XENP019294

SEQ ID NO: 3766 - protein, 12 aa, Artificial Sequence
  Description of Artificial Sequence: Synthetic peptide
  XENP019294 vlCDR1
RASQSVGSSYLA

SEQ ID NO: 3767 - protein, 7 aa, Artificial Sequence
  Description of Artificial Sequence: Synthetic peptide
  XENP019294 vlCDR2
GAFSRAT

SEQ ID NO: 3768 - protein, 9 aa, Artificial Sequence
  Description of Artificial Sequence: Synthetic peptide
  XENP019294 vlCDR3
QQYGSSPWT

SEQ ID NO: 3769 - protein, 221 aa, Artificial Sequence
  Description of Artificial Sequence: Synthetic polypeptide
  XENP019295 [CTLA-4]_H0.85_L0_Fab Heavy Chain
QVQLVESGGGVVQPGRSLRLSCAASGFTFSSYTMHWVRQAPGKGLEWVTFISYDGNNKYYADSVKGRFTMSRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3770 - protein, 118 aa, Artificial Sequence; identical to SEQ ID NO: 949
  Description of Artificial Sequence: Synthetic polypeptide
  VH of XENP019295

SEQ ID NO: 3771 - protein, 5 aa, Artificial Sequence
  Description of Artificial Sequence: Synthetic peptide
  XENP019295 vhCDR1
SYTMH

SEQ ID NO: 3772 - protein, 17 aa, Artificial Sequence
  Description of Artificial Sequence: Synthetic peptide
  XENP019295 vhCDR2
FISYDGNNKYYADSVKG

SEQ ID NO: 3773 - protein, 9 aa, Artificial Sequence
  Description of Artificial Sequence: Synthetic peptide
  XENP019295 vhCDR3
TGWLGPFDY

SEQ ID NO: 3774 - protein, 215 aa, Artificial Sequence; identical to SEQ ID NO: 2924
  Description of Artificial Sequence: Synthetic polypeptide
  XENP019295 [CTLA-4]_H0.85_L0_Fab Light Chain

SEQ ID NO: 3775 - protein, 108 aa, Artificial Sequence; identical to SEQ ID NO: 23
  Description of Artificial Sequence: Synthetic polypeptide
  VL of XENP019295

SEQ ID NO: 3776 - protein, 12 aa, Artificial Sequence
  Description of Artificial Sequence: Synthetic peptide
  XENP019295 vlCDR1
RASQSVGSSYLA

SEQ ID NO: 3777 - protein, 7 aa, Artificial Sequence
  Description of Artificial Sequence: Synthetic peptide
  XENP019295 vlCDR2
GAFSRAT

SEQ ID NO: 3778 - protein, 9 aa, Artificial Sequence
  Description of Artificial Sequence: Synthetic peptide
  XENP019295 vlCDR3
QQYGSSPWT

SEQ ID NO: 3779 - protein, 221 aa, Artificial Sequence
  Description of Artificial Sequence: Synthetic polypeptide
  XENP019296 [CTLA-4]_H0.86_L0_Fab Heavy Chain
QVQLVESGGGVVQPGRSLRLSCAASGFTFSSYTMHWVRQAPGKGLEWVTFISYDGNNKYYADSVKGRFTVSRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3780 - protein, 118 aa, Artificial Sequence; identical to SEQ ID NO: 958
  Description of Artificial Sequence: Synthetic polypeptide
  VH of XENP019296

SEQ ID NO: 3781 - protein, 5 aa, Artificial Sequence
  Description of Artificial Sequence: Synthetic peptide
  XENP019296 vhCDR1
SYTMH

SEQ ID NO: 3782 - protein, 17 aa, Artificial Sequence
  Description of Artificial Sequence: Synthetic peptide
  XENP019296 vhCDR2
FISYDGNNKYYADSVKG

SEQ ID NO: 3783 - protein, 9 aa, Artificial Sequence
  Description of Artificial Sequence: Synthetic peptide
  XENP019296 vhCDR3
TGWLGPFDY

SEQ ID NO: 3784 - protein, 215 aa, Artificial Sequence; identical to SEQ ID NO: 2924
  Description of Artificial Sequence: Synthetic polypeptide
  XENP019296 [CTLA-4]_H0.86_L0_Fab Light Chain

SEQ ID NO: 3785 - protein, 108 aa, Artificial Sequence; identical to SEQ ID NO: 23
  Description of Artificial Sequence: Synthetic polypeptide
  VL of XENP019296

SEQ ID NO: 3786 - protein, 12 aa, Artificial Sequence
  Description of Artificial Sequence: Synthetic peptide
  XENP019296 vlCDR1
RASQSVGSSYLA

SEQ ID NO: 3787 - protein, 7 aa, Artificial Sequence
  Description of Artificial Sequence: Synthetic peptide
  XENP019296 vlCDR2
GAFSRAT

SEQ ID NO: 3788 - protein, 9 aa, Artificial Sequence
  Description of Artificial Sequence: Synthetic peptide
  XENP019296 vlCDR3
QQYGSSPWT

SEQ ID NO: 3789 - protein, 221 aa, Artificial Sequence
  Description of Artificial Sequence: Synthetic polypeptide
  XENP019301 [CTLA-4]_H0.87_L0_Fab Heavy Chain
QVQLVESGGGVVQPGRSLRLSCAASGFTFSSYTMHWVRQAPGKGLEWVTFISYDGNNKYYADSVKGRFTISEDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3790 - protein, 118 aa, Artificial Sequence; identical to SEQ ID NO: 967
  Description of Artificial Sequence: Synthetic polypeptide
  VH of XENP019301

SEQ ID NO: 3791 - protein, 5 aa, Artificial Sequence
  Description of Artificial Sequence: Synthetic peptide
  XENP019301 vhCDR1
SYTMH

SEQ ID NO: 3792 - protein, 17 aa, Artificial Sequence
  Description of Artificial Sequence: Synthetic peptide
  XENP019301 vhCDR2
FISYDGNNKYYADSVKG

SEQ ID NO: 3793 - protein, 9 aa, Artificial Sequence
  Description of Artificial Sequence: Synthetic peptide
  XENP019301 vhCDR3
TGWLGPFDY

SEQ ID NO: 3794 - protein, 215 aa, Artificial Sequence; identical to SEQ ID NO: 2924
  Description of Artificial Sequence: Synthetic polypeptide
  XENP019301 [CTLA-4]_H0.87_L0_Fab Light Chain

SEQ ID NO: 3795 - protein, 108 aa, Artificial Sequence; identical to SEQ ID NO: 23
  Description of Artificial Sequence: Synthetic polypeptide
  VL of XENP019301

SEQ ID NO: 3796 - protein, 12 aa, Artificial Sequence
  Description of Artificial Sequence: Synthetic peptide
  XENP019301 vlCDR1
RASQSVGSSYLA

SEQ ID NO: 3797 - protein, 7 aa, Artificial Sequence
  Description of Artificial Sequence: Synthetic peptide
  XENP019301 vlCDR2
GAFSRAT

SEQ ID NO: 3798 - protein, 9 aa, Artificial Sequence
  Description of Artificial Sequence: Synthetic peptide
  XENP019301 vlCDR3
QQYGSSPWT

SEQ ID NO: 3799 - protein, 221 aa, Artificial Sequence
  Description of Artificial Sequence: Synthetic polypeptide
  XENP019302 [CTLA-4]_H0.88_L0_Fab Heavy Chain
QVQLVESGGGVVQPGRSLRLSCAASGFTFSSYTMHWVRQAPGKGLEWVTFISYDGNNKYYADSVKGRFTISRENSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3800 - protein, 118 aa, Artificial Sequence; identical to SEQ ID NO: 976
  Description of Artificial Sequence: Synthetic polypeptide
  VH of XENP019302

SEQ ID NO: 3801 - protein, 5 aa, Artificial Sequence
  Description of Artificial Sequence: Synthetic peptide
  XENP019302 vhCDR1
SYTMH

SEQ ID NO: 3802 - protein, 17 aa, Artificial Sequence
  Description of Artificial Sequence: Synthetic peptide
  XENP019302 vhCDR2
FISYDGNNKYYADSVKG

SEQ ID NO: 3803 - protein, 9 aa, Artificial Sequence
  Description of Artificial Sequence: Synthetic peptide
  XENP019302 vhCDR3
TGWLGPFDY

SEQ ID NO: 3804 - protein, 215 aa, Artificial Sequence; identical to SEQ ID NO: 2924
  Description of Artificial Sequence: Synthetic polypeptide
  XENP019302 [CTLA-4]_H0.88_L0_Fab Light Chain

SEQ ID NO: 3805 - protein, 108 aa, Artificial Sequence; identical to SEQ ID NO: 23
  Description of Artificial Sequence: Synthetic polypeptide
  VL of XENP019302

SEQ ID NO: 3806 - protein, 12 aa, Artificial Sequence
  Description of Artificial Sequence: Synthetic peptide
  XENP019302 vlCDR1
RASQSVGSSYLA

SEQ ID NO: 3807 - protein, 7 aa, Artificial Sequence
  Description of Artificial Sequence: Synthetic peptide
  XENP019302 vlCDR2
GAFSRAT

SEQ ID NO: 3808 - protein, 9 aa, Artificial Sequence
  Description of Artificial Sequence: Synthetic peptide
  XENP019302 vlCDR3
QQYGSSPWT

SEQ ID NO: 3809 - protein, 221 aa, Artificial Sequence
  Description of Artificial Sequence: Synthetic polypeptide
  XENP019303 [CTLA-4]_H0.89_L0_Fab Heavy Chain
QVQLVESGGGVVQPGRSLRLSCAASGFTFSSYTMHWVRQAPGKGLEWVTFISYDGNNKYYADSVKGRFTISRDDSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3810 - protein, 118 aa, Artificial Sequence; identical to SEQ ID NO: 985
  Description of Artificial Sequence: Synthetic polypeptide
  VH of XENP019303

SEQ ID NO: 3811 - protein, 5 aa, Artificial Sequence
  Description of Artificial Sequence: Synthetic peptide
  XENP019303 vhCDR1
SYTMH

SEQ ID NO: 3812 - protein, 17 aa, Artificial Sequence
  Description of Artificial Sequence: Synthetic peptide
  XENP019303 vhCDR2
FISYDGNNKYYADSVKG

SEQ ID NO: 3813 - protein, 9 aa, Artificial Sequence
  Description of Artificial Sequence: Synthetic peptide
  XENP019303 vhCDR3
TGWLGPFDY

SEQ ID NO: 3814 - protein, 215 aa, Artificial Sequence; identical to SEQ ID NO: 2924
  Description of Artificial Sequence: Synthetic polypeptide
  XENP019303 [CTLA-4]_H0.89_L0_Fab Light Chain

SEQ ID NO: 3815 - protein, 108 aa, Artificial Sequence; identical to SEQ ID NO: 23
  Description of Artificial Sequence: Synthetic polypeptide
  VL of XENP019303

SEQ ID NO: 3816 - protein, 12 aa, Artificial Sequence
  Description of Artificial Sequence: Synthetic peptide
  XENP019303 vlCDR1
RASQSVGSSYLA

SEQ ID NO: 3817 - protein, 7 aa, Artificial Sequence
  Description of Artificial Sequence: Synthetic peptide
  XENP019303 vlCDR2
GAFSRAT

SEQ ID NO: 3818 - protein, 9 aa, Artificial Sequence
  Description of Artificial Sequence: Synthetic peptide
  XENP019303 vlCDR3
QQYGSSPWT

SEQ ID NO: 3819 - protein, 221 aa, Artificial Sequence
  Description of Artificial Sequence: Synthetic polypeptide
  XENP019304 [CTLA-4]_H0.90_L0_Fab Heavy Chain
QVQLVESGGGVVQPGRSLRLSCAASGFTFSSYTMHWVRQAPGKGLEWVTFISYDGNNKYYADSVKGRFTISRDNAKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3820 - protein, 118 aa, Artificial Sequence; identical to SEQ ID NO: 994
  Description of Artificial Sequence: Synthetic polypeptide
  VH of XENP019304

SEQ ID NO: 3821 - protein, 5 aa, Artificial Sequence
  Description of Artificial Sequence: Synthetic peptide
  XENP019304 vhCDR1
SYTMH

SEQ ID NO: 3822 - protein, 17 aa, Artificial Sequence
  Description of Artificial Sequence: Synthetic peptide
  XENP019304 vhCDR2
FISYDGNNKYYADSVKG

SEQ ID NO: 3823 - protein, 9 aa, Artificial Sequence
  Description of Artificial Sequence: Synthetic peptide
  XENP019304 vhCDR3
TGWLGPFDY

SEQ ID NO: 3824 - protein, 215 aa, Artificial Sequence; identical to SEQ ID NO: 2924
  Description of Artificial Sequence: Synthetic polypeptide
  XENP019304 [CTLA-4]_H0.90_L0_Fab Light Chain

SEQ ID NO: 3825 - protein, 108 aa, Artificial Sequence; identical to SEQ ID NO: 23
  Description of Artificial Sequence: Synthetic polypeptide
  VL of XENP019304

SEQ ID NO: 3826 - protein, 12 aa, Artificial Sequence
  Description of Artificial Sequence: Synthetic peptide
  XENP019304 vlCDR1
RASQSVGSSYLA

SEQ ID NO: 3827 - protein, 7 aa, Artificial Sequence
  Description of Artificial Sequence: Synthetic peptide
  XENP019304 vlCDR2
GAFSRAT

SEQ ID NO: 3828 - protein, 9 aa, Artificial Sequence
  Description of Artificial Sequence: Synthetic peptide
  XENP019304 vlCDR3
QQYGSSPWT

SEQ ID NO: 3829 - protein, 221 aa, Artificial Sequence
  Description of Artificial Sequence: Synthetic polypeptide
  XENP019305 [CTLA-4]_H0.91_L0_Fab Heavy Chain
QVQLVESGGGVVQPGRSLRLSCAASGFTFSSYTMHWVRQAPGKGLEWVTFISYDGNNKYYADSVKGRFTISRDNSRNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3830 - protein, 118 aa, Artificial Sequence; identical to SEQ ID NO: 1003
  Description of Artificial Sequence: Synthetic polypeptide
  VH of XENP019305

SEQ ID NO: 3831 - protein, 5 aa, Artificial Sequence
  Description of Artificial Sequence: Synthetic peptide
  XENP019305 vhCDR1
SYTMH

SEQ ID NO: 3832 - protein, 17 aa, Artificial Sequence
  Description of Artificial Sequence: Synthetic peptide
  XENP019305 vhCDR2
FISYDGNNKYYADSVKG

SEQ ID NO: 3833 - protein, 9 aa, Artificial Sequence
  Description of Artificial Sequence: Synthetic peptide
  XENP019305 vhCDR3
TGWLGPFDY

SEQ ID NO: 3834 - protein, 215 aa, Artificial Sequence; identical to SEQ ID NO: 2924
  Description of Artificial Sequence: Synthetic polypeptide
  XENP019305 [CTLA-4]_H0.91_L0_Fab Light Chain

SEQ ID NO: 3835 - protein, 108 aa, Artificial Sequence; identical to SEQ ID NO: 23
  Description of Artificial Sequence: Synthetic polypeptide
  VL of XENP019305

SEQ ID NO: 3836 - protein, 12 aa, Artificial Sequence
  Description of Artificial Sequence: Synthetic peptide
  XENP019305 vlCDR1
RASQSVGSSYLA

SEQ ID NO: 3837 - protein, 7 aa, Artificial Sequence
  Description of Artificial Sequence: Synthetic peptide
  XENP019305 vlCDR2
GAFSRAT

SEQ ID NO: 3838 - protein, 9 aa, Artificial Sequence
  Description of Artificial Sequence: Synthetic peptide
  XENP019305 vlCDR3
QQYGSSPWT

SEQ ID NO: 3839 - protein, 221 aa, Artificial Sequence
  Description of Artificial Sequence: Synthetic polypeptide
  XENP019306 [CTLA-4]_H0.92_L0_Fab Heavy Chain
QVQLVESGGGVVQPGRSLRLSCAASGFTFSSYTMHWVRQAPGKGLEWVTFISYDGNNKYYADSVKGRFTISRDNSKNSLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3840 - protein, 118 aa, Artificial Sequence; identical to SEQ ID NO: 1012
  Description of Artificial Sequence: Synthetic polypeptide
  VH of XENP019306

SEQ ID NO: 3841 - protein, 5 aa, Artificial Sequence
  Description of Artificial Sequence: Synthetic peptide
  XENP019306 vhCDR1
SYTMH

SEQ ID NO: 3842 - protein, 17 aa, Artificial Sequence
  Description of Artificial Sequence: Synthetic peptide
  XENP019306 vhCDR2
FISYDGNNKYYADSVKG

SEQ ID NO: 3843 - protein, 9 aa, Artificial Sequence
  Description of Artificial Sequence: Synthetic peptide
  XENP019306 vhCDR3
TGWLGPFDY

SEQ ID NO: 3844 - protein, 215 aa, Artificial Sequence; identical to SEQ ID NO: 2924
  Description of Artificial Sequence: Synthetic polypeptide
  XENP019306 [CTLA-4]_H0.92_L0_Fab Light Chain

SEQ ID NO: 3845 - protein, 108 aa, Artificial Sequence; identical to SEQ ID NO: 23
  Description of Artificial Sequence: Synthetic polypeptide
  VL of XENP019306

SEQ ID NO: 3846 - protein, 12 aa, Artificial Sequence
  Description of Artificial Sequence: Synthetic peptide
  XENP019306 vlCDR1
RASQSVGSSYLA

SEQ ID NO: 3847 - protein, 7 aa, Artificial Sequence
  Description of Artificial Sequence: Synthetic peptide
  XENP019306 vlCDR2
GAFSRAT

SEQ ID NO: 3848 - protein, 9 aa, Artificial Sequence
  Description of Artificial Sequence: Synthetic peptide
  XENP019306 vlCDR3
QQYGSSPWT

SEQ ID NO: 3849 - protein, 221 aa, Artificial Sequence
  Description of Artificial Sequence: Synthetic polypeptide
  XENP019307 [CTLA-4]_H0.93_L0_Fab Heavy Chain
QVQLVESGGGVVQPGRSLRLSCAASGFTFSSYTMHWVRQAPGKGLEWVTFISYDGNNKYYADSVKGRFTISRDNSKNQLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3850 - protein, 118 aa, Artificial Sequence; identical to SEQ ID NO: 1021
  Description of Artificial Sequence: Synthetic polypeptide
  VH of XENP019307

SEQ ID NO: 3851 - protein, 5 aa, Artificial Sequence
  Description of Artificial Sequence: Synthetic peptide
  XENP019307 vhCDR1
SYTMH

SEQ ID NO: 3852 - protein, 17 aa, Artificial Sequence
  Description of Artificial Sequence: Synthetic peptide
  XENP019307 vhCDR2
FISYDGNNKYYADSVKG

SEQ ID NO: 3853 - protein, 9 aa, Artificial Sequence
  Description of Artificial Sequence: Synthetic peptide
  XENP019307 vhCDR3
TGWLGPFDY

SEQ ID NO: 3854 - protein, 215 aa, Artificial Sequence; identical to SEQ ID NO: 2924
  Description of Artificial Sequence: Synthetic polypeptide
  XENP019307 [CTLA-4]_H0.93_L0_Fab Light Chain

SEQ ID NO: 3855 - protein, 108 aa, Artificial Sequence; identical to SEQ ID NO: 23
  Description of Artificial Sequence: Synthetic polypeptide
  VL of XENP019307

SEQ ID NO: 3856 - protein, 12 aa, Artificial Sequence
  Description of Artificial Sequence: Synthetic peptide
  XENP019307 vlCDR1
RASQSVGSSYLA

SEQ ID NO: 3857 - protein, 7 aa, Artificial Sequence
  Description of Artificial Sequence: Synthetic peptide
  XENP019307 vlCDR2
GAFSRAT

SEQ ID NO: 3858 - protein, 9 aa, Artificial Sequence
  Description of Artificial Sequence: Synthetic peptide
  XENP019307 vlCDR3
QQYGSSPWT

SEQ ID NO: 3859 - protein, 221 aa, Artificial Sequence
  Description of Artificial Sequence: Synthetic polypeptide
  XENP019308 [CTLA-4]_H0.94_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLEMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3860 - protein, 118 aa, Artificial Sequence; identical to SEQ ID NO: 1030
  Description of Artificial Sequence: Synthetic polypeptide
  VH of XENP019308

SEQ ID NO: 3861 - protein, 5 aa, Artificial Sequence
  Description of Artificial Sequence: Synthetic peptide
  XENP019308 vhCDR1
SYTMH

SEQ ID NO: 3862 - protein, 17 aa, Artificial Sequence
  Description of Artificial Sequence: Synthetic peptide
  XENP019308 vhCDR2
FISYDGNNKYYADSVKG

SEQ ID NO: 3863 - protein, 9 aa, Artificial Sequence
  Description of Artificial Sequence: Synthetic peptide
  XENP019308 vhCDR3
TGWLGPFDY

SEQ ID NO: 3864 - protein, 215 aa, Artificial Sequence; identical to SEQ ID NO: 2924
  Description of Artificial Sequence: Synthetic polypeptide
  XENP019308 [CTLA-4]_H0.94_L0_Fab Light Chain

SEQ ID NO: 3865 - protein, 108 aa, Artificial Sequence; identical to SEQ ID NO: 23
  Description of Artificial Sequence: Synthetic polypeptide
  VL of XENP019308

SEQ ID NO: 3866 - protein, 12 aa, Artificial Sequence
  Description of Artificial Sequence: Synthetic peptide
  XENP019308 vlCDR1
RASQSVGSSYLA

SEQ ID NO: 3867 - protein, 7 aa, Artificial Sequence
  Description of Artificial Sequence: Synthetic peptide
  XENP019308 vlCDR2
GAFSRAT

SEQ ID NO: 3868 - protein, 9 aa, Artificial Sequence
  Description of Artificial Sequence: Synthetic peptide
  XENP019308 vlCDR3
QQYGSSPWT

SEQ ID NO: 3869 - protein, 221 aa, Artificial Sequence
  Description of Artificial Sequence: Synthetic polypeptide
  XENP019309 [CTLA-4]_H0.95_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMDSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3870 - protein, 118 aa, Artificial Sequence; identical to SEQ ID NO: 1039
  Description of Artificial Sequence: Synthetic polypeptide
  VH of XENP019309

SEQ ID NO: 3871 - protein, 5 aa, Artificial Sequence
  Description of Artificial Sequence: Synthetic peptide
  XENP019309 vhCDR1
SYTMH

SEQ ID NO: 3872 - protein, 17 aa, Artificial Sequence
  Description of Artificial Sequence: Synthetic peptide
  XENP019309 vhCDR2
FISYDGNNKYYADSVKG

SEQ ID NO: 3873 - protein, 9 aa, Artificial Sequence
  Description of Artificial Sequence: Synthetic peptide
  XENP019309 vhCDR3
TGWLGPFDY

SEQ ID NO: 3874 - protein, 215 aa, Artificial Sequence; identical to SEQ ID NO: 2924
  Description of Artificial Sequence: Synthetic polypeptide
  XENP019309 [CTLA-4]_H0.95_L0_Fab Light Chain

SEQ ID NO: 3875 - protein, 108 aa, Artificial Sequence; identical to SEQ ID NO: 23
  Description of Artificial Sequence: Synthetic polypeptide
  VL of XENP019309

SEQ ID NO: 3876 - protein, 12 aa, Artificial Sequence
  Description of Artificial Sequence: Synthetic peptide
  XENP019309 vlCDR1
RASQSVGSSYLA

SEQ ID NO: 3877 - protein, 7 aa, Artificial Sequence
  Description of Artificial Sequence: Synthetic peptide
  XENP019309 vlCDR2
GAFSRAT

SEQ ID NO: 3878 - protein, 9 aa, Artificial Sequence
  Description of Artificial Sequence: Synthetic peptide
  XENP019309 vlCDR3
QQYGSSPWT

SEQ ID NO: 3879 - protein, 221 aa, Artificial Sequence
  Description of Artificial Sequence: Synthetic polypeptide
  XENP019310 [CTLA-4]_H0.96_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNDLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3880 - protein, 118 aa, Artificial Sequence; identical to SEQ ID NO: 1048
  Description of Artificial Sequence: Synthetic polypeptide
  VH of XENP019310

SEQ ID NO: 3881 - protein, 5 aa, Artificial Sequence
  Description of Artificial Sequence: Synthetic peptide
  XENP019310 vhCDR1
SYTMH

SEQ ID NO: 3882 - protein, 17 aa, Artificial Sequence
  Description of Artificial Sequence: Synthetic peptide
  XENP019310 vhCDR2
FISYDGNNKYYADSVKG

SEQ ID NO: 3883 - protein, 9 aa, Artificial Sequence
  Description of Artificial Sequence: Synthetic peptide
  XENP019310 vhCDR3
TGWLGPFDY

SEQ ID NO: 3884 - protein, 215 aa, Artificial Sequence; identical to SEQ ID NO: 2924
  Description of Artificial Sequence: Synthetic polypeptide
  XENP019310 [CTLA-4]_H0.96_L0_Fab Light Chain

SEQ ID NO: 3885 - protein, 108 aa, Artificial Sequence; identical to SEQ ID NO: 23
  Description of Artificial Sequence: Synthetic polypeptide
  VL of XENP019310

SEQ ID NO: 3886 - protein, 12 aa, Artificial Sequence
  Description of Artificial Sequence: Synthetic peptide
  XENP019310 vlCDR1
RASQSVGSSYLA

SEQ ID NO: 3887 - protein, 7 aa, Artificial Sequence
  Description of Artificial Sequence: Synthetic peptide
  XENP019310 vlCDR2
GAFSRAT

SEQ ID NO: 3888 - protein, 9 aa, Artificial Sequence
  Description of Artificial Sequence: Synthetic peptide
  XENP019310 vlCDR3
QQYGSSPWT

SEQ ID NO: 3889 - protein, 221 aa, Artificial Sequence
  Description of Artificial Sequence: Synthetic polypeptide
  XENP019311 [CTLA-4]_H0.97_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRTEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3890 - protein, 118 aa, Artificial Sequence; identical to SEQ ID NO: 1057
  Description of Artificial Sequence: Synthetic polypeptide
  VH of XENP019311

SEQ ID NO: 3891 - protein, 5 aa, Artificial Sequence
  Description of Artificial Sequence: Synthetic peptide
  XENP019311 vhCDR1
SYTMH

SEQ ID NO: 3892 - protein, 17 aa, Artificial Sequence
  Description of Artificial Sequence: Synthetic peptide
  XENP019311 vhCDR2
FISYDGNNKYYADSVKG

SEQ ID NO: 3893 - protein, 9 aa, Artificial Sequence
  Description of Artificial Sequence: Synthetic peptide
  XENP019311 vhCDR3
TGWLGPFDY

SEQ ID NO: 3894 - protein, 215 aa, Artificial Sequence; identical to SEQ ID NO: 2924
  Description of Artificial Sequence: Synthetic polypeptide
  XENP019311 [CTLA-4]_H0.97_L0_Fab Light Chain

SEQ ID NO: 3895 - protein, 108 aa, Artificial Sequence; identical to SEQ ID NO: 23
  Description of Artificial Sequence: Synthetic polypeptide
  VL of XENP019311

SEQ ID NO: 3896 - protein, 12 aa, Artificial Sequence
  Description of Artificial Sequence: Synthetic peptide
  XENP019311 vlCDR1
RASQSVGSSYLA

SEQ ID NO: 3897 - protein, 7 aa, Artificial Sequence
  Description of Artificial Sequence: Synthetic peptide
  XENP019311 vlCDR2
GAFSRAT

SEQ ID NO: 3898 - protein, 9 aa, Artificial Sequence
  Description of Artificial Sequence: Synthetic peptide
  XENP019311 vlCDR3
QQYGSSPWT

SEQ ID NO: 3899 - protein, 221 aa, Artificial Sequence
  Description of Artificial Sequence: Synthetic polypeptide
  XENP019312 [CTLA-4]_H0.98_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTALYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3900 - protein, 118 aa, Artificial Sequence; identical to SEQ ID NO: 1066
  Description of Artificial Sequence: Synthetic polypeptide
  VH of XENP019312

SEQ ID NO: 3901 - protein, 5 aa, Artificial Sequence
  Description of Artificial Sequence: Synthetic peptide
  XENP019312 vhCDR1
SYTMH

SEQ ID NO: 3902 - protein, 17 aa, Artificial Sequence
  Description of Artificial Sequence: Synthetic peptide
  XENP019312 vhCDR2
FISYDGNNKYYADSVKG

SEQ ID NO: 3903 - protein, 9 aa, Artificial Sequence
  Description of Artificial Sequence: Synthetic peptide
  XENP019312 vhCDR3
TGWLGPFDY

SEQ ID NO: 3904 - protein, 215 aa, Artificial Sequence; identical to SEQ ID NO: 2924
  Description of Artificial Sequence: Synthetic polypeptide
  XENP019312 [CTLA-4]_H0.98_L0_Fab Light Chain

SEQ ID NO: 3905 - protein, 108 aa, Artificial Sequence; identical to SEQ ID NO: 23
  Description of Artificial Sequence: Synthetic polypeptide
  VL of XENP019312

SEQ ID NO: 3906 - protein, 12 aa, Artificial Sequence
  Description of Artificial Sequence: Synthetic peptide
  XENP019312 vlCDR1
RASQSVGSSYLA

SEQ ID NO: 3907 - protein, 7 aa, Artificial Sequence
  Description of Artificial Sequence: Synthetic peptide
  XENP019312 vlCDR2
GAFSRAT

SEQ ID NO: 3908 - protein, 9 aa, Artificial Sequence
  Description of Artificial Sequence: Synthetic peptide
  XENP019312 vlCDR3
QQYGSSPWT

SEQ ID NO: 3909 - protein, 221 aa, Artificial Sequence
  Description of Artificial Sequence: Synthetic polypeptide
  XENP019313 [CTLA-4]_H0.99_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAVYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3910 - protein, 118 aa, Artificial Sequence; identical to SEQ ID NO: 1075
  Description of Artificial Sequence: Synthetic polypeptide
  VH of XENP019313

SEQ ID NO: 3911 - protein, 5 aa, Artificial Sequence
  Description of Artificial Sequence: Synthetic peptide
  XENP019313 vhCDR1
SYTMH

SEQ ID NO: 3912 - protein, 17 aa, Artificial Sequence
  Description of Artificial Sequence: Synthetic peptide
  XENP019313 vhCDR2
FISYDGNNKYYADSVKG

SEQ ID NO: 3913 - protein, 9 aa, Artificial Sequence
  Description of Artificial Sequence: Synthetic peptide
  XENP019313 vhCDR3
TGWLGPFDY

SEQ ID NO: 3914 - protein, 215 aa, Artificial Sequence; identical to SEQ ID NO: 2924
  Description of Artificial Sequence: Synthetic polypeptide
  XENP019313 [CTLA-4]_H0.99_L0_Fab Light Chain

SEQ ID NO: 3915 - protein, 108 aa, Artificial Sequence; identical to SEQ ID NO: 23
  Description of Artificial Sequence: Synthetic polypeptide
  VL of XENP019313

SEQ ID NO: 3916 - protein, 12 aa, Artificial Sequence
  Description of Artificial Sequence: Synthetic peptide
  XENP019313 vlCDR1
RASQSVGSSYLA

SEQ ID NO: 3917 - protein, 7 aa, Artificial Sequence
  Description of Artificial Sequence: Synthetic peptide
  XENP019313 vlCDR2
GAFSRAT

SEQ ID NO: 3918 - protein, 9 aa, Artificial Sequence
  Description of Artificial Sequence: Synthetic peptide
  XENP019313 vlCDR3
QQYGSSPWT

SEQ ID NO: 3919 - protein, 221 aa, Artificial Sequence
  Description of Artificial Sequence: Synthetic polypeptide
  XENP019314 [CTLA-4]_H0.100_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCTRTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3920 - protein, 118 aa, Artificial Sequence; identical to SEQ ID NO: 1084
  Description of Artificial Sequence: Synthetic polypeptide
  VH of XENP019314

SEQ ID NO: 3921 - protein, 5 aa, Artificial Sequence
  Description of Artificial Sequence: Synthetic peptide
  XENP019314 vhCDR1
SYTMH

SEQ ID NO: 3922 - protein, 17 aa, Artificial Sequence
  Description of Artificial Sequence: Synthetic peptide
  XENP019314 vhCDR2
FISYDGNNKYYADSVKG

SEQ ID NO: 3923 - protein, 9 aa, Artificial Sequence
  Description of Artificial Sequence: Synthetic peptide
  XENP019314 vhCDR3
TGWLGPFDY

SEQ ID NO: 3924 - protein, 215 aa, Artificial Sequence; identical to SEQ ID NO: 2924
  Description of Artificial Sequence: Synthetic polypeptide
  XENP019314 [CTLA-4]_H0.100_L0_Fab Light Chain

SEQ ID NO: 3925 - protein, 108 aa, Artificial Sequence; identical to SEQ ID NO: 23
  Description of Artificial Sequence: Synthetic polypeptide
  VL of XENP019314

SEQ ID NO: 3926 - protein, 12 aa, Artificial Sequence
  Description of Artificial Sequence: Synthetic peptide
  XENP019314 vlCDR1
RASQSVGSSYLA

SEQ ID NO: 3927 - protein, 7 aa, Artificial Sequence
  Description of Artificial Sequence: Synthetic peptide
  XENP019314 vlCDR2
GAFSRAT

SEQ ID NO: 3928 - protein, 9 aa, Artificial Sequence
  Description of Artificial Sequence: Synthetic peptide
  XENP019314 vlCDR3
QQYGSSPWT

SEQ ID NO: 3929 - protein, 221 aa, Artificial Sequence
  Description of Artificial Sequence: Synthetic polypeptide
  XENP019315 [CTLA-4]_H0.101_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCAKTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3930 - protein, 118 aa, Artificial Sequence; identical to SEQ ID NO: 1093
  Description of Artificial Sequence: Synthetic polypeptide
  VH of XENP019315

SEQ ID NO: 3931 - protein, 5 aa, Artificial Sequence
  Description of Artificial Sequence: Synthetic peptide
  XENP019315 vhCDR1
SYTMH

SEQ ID NO: 3932 - protein, 17 aa, Artificial Sequence
  Description of Artificial Sequence: Synthetic peptide
  XENP019315 vhCDR2
FISYDGNNKYYADSVKG

SEQ ID NO: 3933 - protein, 9 aa, Artificial Sequence
  Description of Artificial Sequence: Synthetic peptide
  XENP019315 vhCDR3
TGWLGPFDY

SEQ ID NO: 3934 - protein, 215 aa, Artificial Sequence; identical to SEQ ID NO: 2924
  Description of Artificial Sequence: Synthetic polypeptide
  XENP019315 [CTLA-4]_H0.101_L0_Fab Light Chain

SEQ ID NO: 3935 - protein, 108 aa, Artificial Sequence; identical to SEQ ID NO: 23
  Description of Artificial Sequence: Synthetic polypeptide
  VL of XENP019315

SEQ ID NO: 3936 - protein, 12 aa, Artificial Sequence
  Description of Artificial Sequence: Synthetic peptide
  XENP019315 vlCDR1
RASQSVGSSYLA

SEQ ID NO: 3937 - protein, 7 aa, Artificial Sequence
  Description of Artificial Sequence: Synthetic peptide
  XENP019315 vlCDR2
GAFSRAT

SEQ ID NO: 3938 - protein, 9 aa, Artificial Sequence
  Description of Artificial Sequence: Synthetic peptide
  XENP019315 vlCDR3
QQYGSSPWT

SEQ ID NO: 3939 - protein, 221 aa, Artificial Sequence
  Description of Artificial Sequence: Synthetic polypeptide
  XENP019316 [CTLA-4]_H0.102_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARAGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3940 - protein, 118 aa, Artificial Sequence; identical to SEQ ID NO: 1102
  Description of Artificial Sequence: Synthetic polypeptide
  VH of XENP019316

SEQ ID NO: 3941 - protein, 5 aa, Artificial Sequence
  Description of Artificial Sequence: Synthetic peptide
  XENP019316 vhCDR1
SYTMH

SEQ ID NO: 3942 - protein, 17 aa, Artificial Sequence
  Description of Artificial Sequence: Synthetic peptide
  XENP019316 vhCDR2
FISYDGNNKYYADSVKG

SEQ ID NO: 3943 - protein, 9 aa, Artificial Sequence
  Description of Artificial Sequence: Synthetic peptide
  XENP019316 vhCDR3
AGWLGPFDY

SEQ ID NO: 3944 - protein, 215 aa, Artificial Sequence; identical to SEQ ID NO: 2924
  Description of Artificial Sequence: Synthetic polypeptide
  XENP019316 [CTLA-4]_H0.102_L0_Fab Light Chain

SEQ ID NO: 3945 - protein, 108 aa, Artificial Sequence; identical to SEQ ID NO: 23
  Description of Artificial Sequence: Synthetic polypeptide
  VL of XENP019316

SEQ ID NO: 3946 - protein, 12 aa, Artificial Sequence
  Description of Artificial Sequence: Synthetic peptide
  XENP019316 vlCDR1
RASQSVGSSYLA

SEQ ID NO: 3947 - protein, 7 aa, Artificial Sequence
  Description of Artificial Sequence: Synthetic peptide
  XENP019316 vlCDR2
GAFSRAT

SEQ ID NO: 3948 - protein, 9 aa, Artificial Sequence
  Description of Artificial Sequence: Synthetic peptide
  XENP019316 vlCDR3
QQYGSSPWT

SEQ ID NO: 3949 - protein, 221 aa, Artificial Sequence
  Description of Artificial Sequence: Synthetic polypeptide
  XENP019317 [CTLA-4]_H0.103_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARGGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3950 - protein, 118 aa, Artificial Sequence; identical to SEQ ID NO: 1111
  Description of Artificial Sequence: Synthetic polypeptide
  VH of XENP019317

SEQ ID NO: 3951 - protein, 5 aa, Artificial Sequence
  Description of Artificial Sequence: Synthetic peptide
  XENP019317 vhCDR1
SYTMH

SEQ ID NO: 3952 - protein, 17 aa, Artificial Sequence
  Description of Artificial Sequence: Synthetic peptide
  XENP019317 vhCDR2
FISYDGNNKYYADSVKG

SEQ ID NO: 3953 - protein, 9 aa, Artificial Sequence
  Description of Artificial Sequence: Synthetic peptide
  XENP019317 vhCDR3
GGWLGPFDY

SEQ ID NO: 3954 - protein, 215 aa, Artificial Sequence; identical to SEQ ID NO: 2924
  Description of Artificial Sequence: Synthetic polypeptide
  XENP019317 [CTLA-4]_H0.103_L0_Fab Light Chain

SEQ ID NO: 3955 - protein, 108 aa, Artificial Sequence; identical to SEQ ID NO: 23
  Description of Artificial Sequence: Synthetic polypeptide
  VL of XENP019317

SEQ ID NO: 3956 - protein, 12 aa, Artificial Sequence
  Description of Artificial Sequence: Synthetic peptide
  XENP019317 vlCDR1
RASQSVGSSYLA

SEQ ID NO: 3957 - protein, 7 aa, Artificial Sequence
  Description of Artificial Sequence: Synthetic peptide
  XENP019317 vlCDR2
GAFSRAT

SEQ ID NO: 3958 - protein, 9 aa, Artificial Sequence
  Description of Artificial Sequence: Synthetic peptide
  XENP019317 vlCDR3
QQYGSSPWT

SEQ ID NO: 3959 - protein, 221 aa, Artificial Sequence
  Description of Artificial Sequence: Synthetic polypeptide
  XENP019318 [CTLA-4]_H0.104_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARDGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3960 - protein, 118 aa, Artificial Sequence; identical to SEQ ID NO: 1120
  Description of Artificial Sequence: Synthetic polypeptide
  VH of XENP019318

SEQ ID NO: 3961 - protein, 5 aa, Artificial Sequence
  Description of Artificial Sequence: Synthetic peptide
  XENP019318 vhCDR1
SYTMH

SEQ ID NO: 3962 - protein, 17 aa, Artificial Sequence
  Description of Artificial Sequence: Synthetic peptide
  XENP019318 vhCDR2
FISYDGNNKYYADSVKG

SEQ ID NO: 3963 - protein, 9 aa, Artificial Sequence
  Description of Artificial Sequence: Synthetic peptide
  XENP019318 vhCDR3
DGWLGPFDY

SEQ ID NO: 3964 - protein, 215 aa, Artificial Sequence; identical to SEQ ID NO: 2924
  Description of Artificial Sequence: Synthetic polypeptide
  XENP019318 [CTLA-4]_H0.104_L0_Fab Light Chain

SEQ ID NO: 3965 - protein, 108 aa, Artificial Sequence; identical to SEQ ID NO: 23
  Description of Artificial Sequence: Synthetic polypeptide
  VL of XENP019318

SEQ ID NO: 3966 - protein, 12 aa, Artificial Sequence
  Description of Artificial Sequence: Synthetic peptide
  XENP019318 vlCDR1
RASQSVGSSYLA

SEQ ID NO: 3967 - protein, 7 aa, Artificial Sequence
  Description of Artificial Sequence: Synthetic peptide
  XENP019318 vlCDR2
GAFSRAT

SEQ ID NO: 3968 - protein, 9 aa, Artificial Sequence
  Description of Artificial Sequence: Synthetic peptide
  XENP019318 vlCDR3
QQYGSSPWT

SEQ ID NO: 3969 - protein, 221 aa, Artificial Sequence
  Description of Artificial Sequence: Synthetic polypeptide
  XENP019319 [CTLA-4]_H0.105_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARSGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3970 - protein, 118 aa, Artificial Sequence; identical to SEQ ID NO: 1129
  Description of Artificial Sequence: Synthetic polypeptide
  VH of XENP019319

SEQ ID NO: 3971 - protein, 5 aa, Artificial Sequence
  Description of Artificial Sequence: Synthetic peptide
  XENP019319 vhCDR1
SYTMH

SEQ ID NO: 3972 - protein, 17 aa, Artificial Sequence
  Description of Artificial Sequence: Synthetic peptide
  XENP019319 vhCDR2
FISYDGNNKYYADSVKG

SEQ ID NO: 3973 - protein, 9 aa, Artificial Sequence
  Description of Artificial Sequence: Synthetic peptide
  XENP019319 vhCDR3
SGWLGPFDY

SEQ ID NO: 3974 - protein, 215 aa, Artificial Sequence; identical to SEQ ID NO: 2924
  Description of Artificial Sequence: Synthetic polypeptide
  XENP019319 [CTLA-4]_H0.105_L0_Fab Light Chain

SEQ ID NO: 3975 - protein, 108 aa, Artificial Sequence; identical to SEQ ID NO: 23
  Description of Artificial Sequence: Synthetic polypeptide
  VL of XENP019319

SEQ ID NO: 3976 - protein, 12 aa, Artificial Sequence
  Description of Artificial Sequence: Synthetic peptide
  XENP019319 vlCDR1
RASQSVGSSYLA

SEQ ID NO: 3977 - protein, 7 aa, Artificial Sequence
  Description of Artificial Sequence: Synthetic peptide
  XENP019319 vlCDR2
GAFSRAT

SEQ ID NO: 3978 - protein, 9 aa, Artificial Sequence
  Description of Artificial Sequence: Synthetic peptide
  XENP019319 vlCDR3
QQYGSSPWT

SEQ ID NO: 3979 - protein, 221 aa, Artificial Sequence
  Description of Artificial Sequence: Synthetic polypeptide
  XENP019320 [CTLA-4]_H0.106_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARVGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3980 - protein, 118 aa, Artificial Sequence; identical to SEQ ID NO: 1138
  Description of Artificial Sequence: Synthetic polypeptide
  VH of XENP019320

SEQ ID NO: 3981 - protein, 5 aa, Artificial Sequence
  Description of Artificial Sequence: Synthetic peptide
  XENP019320 vhCDR1
SYTMH

SEQ ID NO: 3982 - protein, 17 aa, Artificial Sequence
  Description of Artificial Sequence: Synthetic peptide
  XENP019320 vhCDR2
FISYDGNNKYYADSVKG

SEQ ID NO: 3983 - protein, 9 aa, Artificial Sequence
  Description of Artificial Sequence: Synthetic peptide
  XENP019320 vhCDR3
VGWLGPFDY

SEQ ID NO: 3984 - protein, 215 aa, Artificial Sequence; identical to SEQ ID NO: 2924
  Description of Artificial Sequence: Synthetic polypeptide
  XENP019320 [CTLA-4]_H0.106_L0_Fab Light Chain

SEQ ID NO: 3985 - protein, 108 aa, Artificial Sequence; identical to SEQ ID NO: 23
  Description of Artificial Sequence: Synthetic polypeptide
  VL of XENP019320

SEQ ID NO: 3986 - protein, 12 aa, Artificial Sequence
  Description of Artificial Sequence: Synthetic peptide
  XENP019320 vlCDR1
RASQSVGSSYLA

SEQ ID NO: 3987 - protein, 7 aa, Artificial Sequence
  Description of Artificial Sequence: Synthetic peptide
  XENP019320 vlCDR2
GAFSRAT

SEQ ID NO: 3988 - protein, 9 aa, Artificial Sequence
  Description of Artificial Sequence: Synthetic peptide
  XENP019320 vlCDR3
QQYGSSPWT

SEQ ID NO: 3989 - protein, 221 aa, Artificial Sequence
  Description of Artificial Sequence: Synthetic polypeptide
  XENP019321 [CTLA-4]_H0.107_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARYGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 3990 - protein, 118 aa, Artificial Sequence; identical to SEQ ID NO: 1147
  Description of Artificial Sequence: Synthetic polypeptide
  VH of XENP019321

SEQ ID NO: 3991 - protein, 5 aa, Artificial Sequence
  Description of Artificial Sequence: Synthetic peptide
  XENP019321 vhCDR1
SYTMH

SEQ ID NO: 3992 - protein, 17 aa, Artificial Sequence
  Description of Artificial Sequence: Synthetic peptide
  XENP019321 vhCDR2
FISYDGNNKYYADSVKG

SEQ ID NO: 3993 - protein, 9 aa, Artificial Sequence
  Description of Artificial Sequence: Synthetic peptide
  XENP019321 vhCDR3
YGWLGPFDY

SEQ ID NO: 3994 - protein, 215 aa, Artificial Sequence; identical to SEQ ID NO: 2924
  Description of Artificial Sequence: Synthetic polypeptide
  XENP019321 [CTLA-4]_H0.107_L0_Fab Light Chain

SEQ ID NO: 3995 - protein, 108 aa, Artificial Sequence; identical to SEQ ID NO: 23
  Description of Artificial Sequence: Synthetic polypeptide
  VL of XENP019321

SEQ ID NO: 3996 - protein, 12 aa, Artificial Sequence
  Description of Artificial Sequence: Synthetic peptide
  XENP019321 vlCDR1
RASQSVGSSYLA

SEQ ID NO: 3997 - protein, 7 aa, Artificial Sequence
  Description of Artificial Sequence: Synthetic peptide
  XENP019321 vlCDR2
GAFSRAT

SEQ ID NO: 3998 - protein, 9 aa, Artificial Sequence
  Description of Artificial Sequence: Synthetic peptide
  XENP019321 vlCDR3
QQYGSSPWT

SEQ ID NO: 3999 - protein, 221 aa, Artificial Sequence
  Description of Artificial Sequence: Synthetic polypeptide
  XENP019322 [CTLA-4]_H0.108_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTAWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4000 - protein, 118 aa, Artificial Sequence; identical to SEQ ID NO: 1156
  Description of Artificial Sequence: Synthetic polypeptide
  VH of XENP019322

SEQ ID NO: 4001 - protein, 5 aa, Artificial Sequence
  Description of Artificial Sequence: Synthetic peptide
  XENP019322 vhCDR1
SYTMH

SEQ ID NO: 4002 - protein, 17 aa, Artificial Sequence
  Description of Artificial Sequence: Synthetic peptide
  XENP019322 vhCDR2
FISYDGNNKYYADSVKG

SEQ ID NO: 4003 - protein, 9 aa, Artificial Sequence
  Description of Artificial Sequence: Synthetic peptide
  XENP019322 vhCDR3
TAWLGPFDY

SEQ ID NO: 4004 - protein, 215 aa, Artificial Sequence; identical to SEQ ID NO: 2924
  Description of Artificial Sequence: Synthetic polypeptide
  XENP019322 [CTLA-4]_H0.108_L0_Fab Light Chain

SEQ ID NO: 4005 - protein, 108 aa, Artificial Sequence; identical to SEQ ID NO: 23
  Description of Artificial Sequence: Synthetic polypeptide
  VL of XENP019322

SEQ ID NO: 4006 - protein, 12 aa, Artificial Sequence
  Description of Artificial Sequence: Synthetic peptide
  XENP019322 vlCDR1
RASQSVGSSYLA

SEQ ID NO: 4007 - protein, 7 aa, Artificial Sequence
  Description of Artificial Sequence: Synthetic peptide
  XENP019322 vlCDR2
GAFSRAT

SEQ ID NO: 4008 - protein, 9 aa, Artificial Sequence
  Description of Artificial Sequence: Synthetic peptide
  XENP019322 vlCDR3
QQYGSSPWT

SEQ ID NO: 4009 - protein, 221 aa, Artificial Sequence
  Description of Artificial Sequence: Synthetic polypeptide
  XENP019323 [CTLA-4]_H0.109_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTSWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4010 - protein, 118 aa, Artificial Sequence; identical to SEQ ID NO: 1165
  Description of Artificial Sequence: Synthetic polypeptide
  VH of XENP019323

SEQ ID NO: 4011 - protein, 5 aa, Artificial Sequence
  Description of Artificial Sequence: Synthetic peptide
  XENP019323 vhCDR1
SYTMH

SEQ ID NO: 4012 - protein, 17 aa, Artificial Sequence
  Description of Artificial Sequence: Synthetic peptide
  XENP019323 vhCDR2
FISYDGNNKYYADSVKG

SEQ ID NO: 4013 - protein, 9 aa, Artificial Sequence
  Description of Artificial Sequence: Synthetic peptide
  XENP019323 vhCDR3
TSWLGPFDY

SEQ ID NO: 4014 - protein, 215 aa, Artificial Sequence; identical to SEQ ID NO: 2924
  Description of Artificial Sequence: Synthetic polypeptide
  XENP019323 [CTLA-4]_H0.109_L0_Fab Light Chain

SEQ ID NO: 4015 - protein, 108 aa, Artificial Sequence; identical to SEQ ID NO: 23
  Description of Artificial Sequence: Synthetic polypeptide
  VL of XENP019323

SEQ ID NO: 4016 - protein, 12 aa, Artificial Sequence
  Description of Artificial Sequence: Synthetic peptide
  XENP019323 vlCDR1
RASQSVGSSYLA

SEQ ID NO: 4017 - protein, 7 aa, Artificial Sequence
  Description of Artificial Sequence: Synthetic peptide
  XENP019323 vlCDR2
GAFSRAT

SEQ ID NO: 4018 - protein, 9 aa, Artificial Sequence
  Description of Artificial Sequence: Synthetic peptide
  XENP019323 vlCDR3
QQYGSSPWT

SEQ ID NO: 4019 - protein, 221 aa, Artificial Sequence
  Description of Artificial Sequence: Synthetic polypeptide
  XENP019324 [CTLA-4]_H0.110_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTTWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4020 - protein, 118 aa, Artificial Sequence; identical to SEQ ID NO: 1174
  Description of Artificial Sequence: Synthetic polypeptide
  VH of XENP019324

SEQ ID NO: 4021 - protein, 5 aa, Artificial Sequence
  Description of Artificial Sequence: Synthetic peptide
  XENP019324 vhCDR1
SYTMH

SEQ ID NO: 4022 - protein, 17 aa, Artificial Sequence
  Description of Artificial Sequence: Synthetic peptide
  XENP019324 vhCDR2
FISYDGNNKYYADSVKG

SEQ ID NO: 4023 - protein, 9 aa, Artificial Sequence
  Description of Artificial Sequence: Synthetic peptide
  XENP019324 vhCDR3
TTWLGPFDY

SEQ ID NO: 4024 - protein, 215 aa, Artificial Sequence; identical to SEQ ID NO: 2924
  Description of Artificial Sequence: Synthetic polypeptide
  XENP019324 [CTLA-4]_H0.110_L0_Fab Light Chain

SEQ ID NO: 4025 - protein, 108 aa, Artificial Sequence; identical to SEQ ID NO: 23
  Description of Artificial Sequence: Synthetic polypeptide
  VL of XENP019324

SEQ ID NO: 4026 - protein, 12 aa, Artificial Sequence
  Description of Artificial Sequence: Synthetic peptide
  XENP019324 vlCDR1
RASQSVGSSYLA

SEQ ID NO: 4027 - protein, 7 aa, Artificial Sequence
  Description of Artificial Sequence: Synthetic peptide
  XENP019324 vlCDR2
GAFSRAT

SEQ ID NO: 4028 - protein, 9 aa, Artificial Sequence
  Description of Artificial Sequence: Synthetic peptide
  XENP019324 vlCDR3
QQYGSSPWT

SEQ ID NO: 4029 - protein, 221 aa, Artificial Sequence
  Description of Artificial Sequence: Synthetic polypeptide
  XENP019325 [CTLA-4]_H0.111_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGFLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4030 - protein, 118 aa, Artificial Sequence; identical to SEQ ID NO: 1183
  Description of Artificial Sequence: Synthetic polypeptide
  VH of XENP019325

SEQ ID NO: 4031 - protein, 5 aa, Artificial Sequence
  Description of Artificial Sequence: Synthetic peptide
  XENP019325 vhCDR1
SYTMH

SEQ ID NO: 4032 - protein, 17 aa, Artificial Sequence
  Description of Artificial Sequence: Synthetic peptide
  XENP019325 vhCDR2
FISYDGNNKYYADSVKG

SEQ ID NO: 4033 - protein, 9 aa, Artificial Sequence
  Description of Artificial Sequence: Synthetic peptide
  XENP019325 vhCDR3
TGFLGPFDY

SEQ ID NO: 4034 - protein, 215 aa, Artificial Sequence; identical to SEQ ID NO: 2924
  Description of Artificial Sequence: Synthetic polypeptide
  XENP019325 [CTLA-4]_H0.111_L0_Fab Light Chain

SEQ ID NO: 4035 - protein, 108 aa, Artificial Sequence; identical to SEQ ID NO: 23
  Description of Artificial Sequence: Synthetic polypeptide
  VL of XENP019325

SEQ ID NO: 4036 - protein, 12 aa, Artificial Sequence
  Description of Artificial Sequence: Synthetic peptide
  XENP019325 vlCDR1
RASQSVGSSYLA

SEQ ID NO: 4037 - protein, 7 aa, Artificial Sequence
  Description of Artificial Sequence: Synthetic peptide
  XENP019325 vlCDR2
GAFSRAT

SEQ ID NO: 4038 - protein, 9 aa, Artificial Sequence
  Description of Artificial Sequence: Synthetic peptide
  XENP019325 vlCDR3
QQYGSSPWT

SEQ ID NO: 4039 - protein, 221 aa, Artificial Sequence
  Description of Artificial Sequence: Synthetic polypeptide
  XENP019326 [CTLA-4]_H0.112_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGGLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4040 - protein, 118 aa, Artificial Sequence; identical to SEQ ID NO: 1192
  Description of Artificial Sequence: Synthetic polypeptide
  VH of XENP019326

SEQ ID NO: 4041 - protein, 5 aa, Artificial Sequence
  Description of Artificial Sequence: Synthetic peptide
  XENP019326 vhCDR1
SYTMH

SEQ ID NO: 4042 - protein, 17 aa, Artificial Sequence
  Description of Artificial Sequence: Synthetic peptide
  XENP019326 vhCDR2
FISYDGNNKYYADSVKG

SEQ ID NO: 4043 - protein, 9 aa, Artificial Sequence
  Description of Artificial Sequence: Synthetic peptide
  XENP019326 vhCDR3
TGGLGPFDY

SEQ ID NO: 4044 - protein, 215 aa, Artificial Sequence; identical to SEQ ID NO: 2924
  Description of Artificial Sequence: Synthetic polypeptide
  XENP019326 [CTLA-4]_H0.112_L0_Fab Light Chain

SEQ ID NO: 4045 - protein, 108 aa, Artificial Sequence; identical to SEQ ID NO: 23
  Description of Artificial Sequence: Synthetic polypeptide
  VL of XENP019326

SEQ ID NO: 4046 - protein, 12 aa, Artificial Sequence
  Description of Artificial Sequence: Synthetic peptide
  XENP019326 vlCDR1
RASQSVGSSYLA

SEQ ID NO: 4047 - protein, 7 aa, Artificial Sequence
  Description of Artificial Sequence: Synthetic peptide
  XENP019326 vlCDR2
GAFSRAT

SEQ ID NO: 4048 - protein, 9 aa, Artificial Sequence
  Description of Artificial Sequence: Synthetic peptide
  XENP019326 vlCDR3
QQYGSSPWT

SEQ ID NO: 4049 - protein, 221 aa, Artificial Sequence
  Description of Artificial Sequence: Synthetic polypeptide
  XENP019327 [CTLA-4]_H0.113_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGHLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4050 - protein, 118 aa, Artificial Sequence; identical to SEQ ID NO: 1201
  Description of Artificial Sequence: Synthetic polypeptide
  VH of XENP019327

SEQ ID NO: 4051 - protein, 5 aa, Artificial Sequence
  Description of Artificial Sequence: Synthetic peptide
  XENP019327 vhCDR1
SYTMH

SEQ ID NO: 4052 - protein, 17 aa, Artificial Sequence
  Description of Artificial Sequence: Synthetic peptide
  XENP019327 vhCDR2
FISYDGNNKYYADSVKG

SEQ ID NO: 4053 - protein, 9 aa, Artificial Sequence
  Description of Artificial Sequence: Synthetic peptide
  XENP019327 vhCDR3
TGHLGPFDY

SEQ ID NO: 4054 - protein, 215 aa, Artificial Sequence; identical to SEQ ID NO: 2924
  Description of Artificial Sequence: Synthetic polypeptide
  XENP019327 [CTLA-4]_H0.113_L0_Fab Light Chain

SEQ ID NO: 4055 - protein, 108 aa, Artificial Sequence; identical to SEQ ID NO: 23
  Description of Artificial Sequence: Synthetic polypeptide
  VL of XENP019327

SEQ ID NO: 4056 - protein, 12 aa, Artificial Sequence
  Description of Artificial Sequence: Synthetic peptide
  XENP019327 vlCDR1
RASQSVGSSYLA

SEQ ID NO: 4057 - protein, 7 aa, Artificial Sequence
  Description of Artificial Sequence: Synthetic peptide
  XENP019327 vlCDR2
GAFSRAT

SEQ ID NO: 4058 - protein, 9 aa, Artificial Sequence
  Description of Artificial Sequence: Synthetic peptide
  XENP019327 vlCDR3
QQYGSSPWT

SEQ ID NO: 4059 - protein, 221 aa, Artificial Sequence
  Description of Artificial Sequence: Synthetic polypeptide
  XENP019328 [CTLA-4]_H0.114_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGLLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4060 - protein, 118 aa, Artificial Sequence; identical to SEQ ID NO: 1210
  Description of Artificial Sequence: Synthetic polypeptide
  VH of XENP019328

SEQ ID NO: 4061 - protein, 5 aa, Artificial Sequence
  Description of Artificial Sequence: Synthetic peptide
  XENP019328 vhCDR1
SYTMH

SEQ ID NO: 4062 - protein, 17 aa, Artificial Sequence
  Description of Artificial Sequence: Synthetic peptide
  XENP019328 vhCDR2
FISYDGNNKYYADSVKG

SEQ ID NO: 4063 - protein, 9 aa, Artificial Sequence
  Description of Artificial Sequence: Synthetic peptide
  XENP019328 vhCDR3
TGLLGPFDY

SEQ ID NO: 4064 - protein, 215 aa, Artificial Sequence; identical to SEQ ID NO: 2924
  Description of Artificial Sequence: Synthetic polypeptide
  XENP019328 [CTLA-4]_H0.114_L0_Fab Light Chain

SEQ ID NO: 4065 - protein, 108 aa, Artificial Sequence; identical to SEQ ID NO: 23
  Description of Artificial Sequence: Synthetic polypeptide
  VL of XENP019328

SEQ ID NO: 4066 - protein, 12 aa, Artificial Sequence
  Description of Artificial Sequence: Synthetic peptide
  XENP019328 vlCDR1
RASQSVGSSYLA

SEQ ID NO: 4067 - protein, 7 aa, Artificial Sequence
  Description of Artificial Sequence: Synthetic peptide
  XENP019328 vlCDR2
GAFSRAT

SEQ ID NO: 4068 - protein, 9 aa, Artificial Sequence
  Description of Artificial Sequence: Synthetic peptide
  XENP019328 vlCDR3
QQYGSSPWT

SEQ ID NO: 4069 - protein, 221 aa, Artificial Sequence
  Description of Artificial Sequence: Synthetic polypeptide
  XENP019329 [CTLA-4]_H0.115_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGYLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4070 - protein, 118 aa, Artificial Sequence; identical to SEQ ID NO: 1219
  Description of Artificial Sequence: Synthetic polypeptide
  VH of XENP019329

SEQ ID NO: 4071 - protein, 5 aa, Artificial Sequence
  Description of Artificial Sequence: Synthetic peptide
  XENP019329 vhCDR1
SYTMH

SEQ ID NO: 4072 - protein, 17 aa, Artificial Sequence
  Description of Artificial Sequence: Synthetic peptide
  XENP019329 vhCDR2
FISYDGNNKYYADSVKG

SEQ ID NO: 4073 - protein, 9 aa, Artificial Sequence
  Description of Artificial Sequence: Synthetic peptide
  XENP019329 vhCDR3
TGYLGPFDY

SEQ ID NO: 4074 - protein, 215 aa, Artificial Sequence; identical to SEQ ID NO: 2924
  Description of Artificial Sequence: Synthetic polypeptide
  XENP019329 [CTLA-4]_H0.115_L0_Fab Light Chain

SEQ ID NO: 4075 - protein, 108 aa, Artificial Sequence; identical to SEQ ID NO: 23
  Description of Artificial Sequence: Synthetic polypeptide
  VL of XENP019329

SEQ ID NO: 4076 - protein, 12 aa, Artificial Sequence
  Description of Artificial Sequence: Synthetic peptide
  XENP019329 vlCDR1
RASQSVGSSYLA

SEQ ID NO: 4077 - protein, 7 aa, Artificial Sequence
  Description of Artificial Sequence: Synthetic peptide
  XENP019329 vlCDR2
GAFSRAT

SEQ ID NO: 4078 - protein, 9 aa, Artificial Sequence
  Description of Artificial Sequence: Synthetic peptide
  XENP019329 vlCDR3
QQYGSSPWT

SEQ ID NO: 4079 - protein, 221 aa, Artificial Sequence
  Description of Artificial Sequence: Synthetic polypeptide
  XENP019330 [CTLA-4]_H0.116_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWDGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4080 - protein, 118 aa, Artificial Sequence; identical to SEQ ID NO: 1228
  Description of Artificial Sequence: Synthetic polypeptide
  VH of XENP019330

SEQ ID NO: 4081 - protein, 5 aa, Artificial Sequence
  Description of Artificial Sequence: Synthetic peptide
  XENP019330 vhCDR1
SYTMH

SEQ ID NO: 4082 - protein, 17 aa, Artificial Sequence
  Description of Artificial Sequence: Synthetic peptide
  XENP019330 vhCDR2
FISYDGNNKYYADSVKG

SEQ ID NO: 4083 - protein, 9 aa, Artificial Sequence
  Description of Artificial Sequence: Synthetic peptide
  XENP019330 vhCDR3
TGWDGPFDY

SEQ ID NO: 4084 - protein, 215 aa, Artificial Sequence; identical to SEQ ID NO: 2924
  Description of Artificial Sequence: Synthetic polypeptide
  XENP019330 [CTLA-4]_H0.116_L0_Fab Light Chain

SEQ ID NO: 4085 - protein, 108 aa, Artificial Sequence; identical to SEQ ID NO: 23
  Description of Artificial Sequence: Synthetic polypeptide
  VL of XENP019330

SEQ ID NO: 4086 - protein, 12 aa, Artificial Sequence
  Description of Artificial Sequence: Synthetic peptide
  XENP019330 vlCDR1
RASQSVGSSYLA

SEQ ID NO: 4087 - protein, 7 aa, Artificial Sequence
  Description of Artificial Sequence: Synthetic peptide
  XENP019330 vlCDR2
GAFSRAT

SEQ ID NO: 4088 - protein, 9 aa, Artificial Sequence
  Description of Artificial Sequence: Synthetic peptide
  XENP019330 vlCDR3
QQYGSSPWT

SEQ ID NO: 4089 - protein, 221 aa, Artificial Sequence
  Description of Artificial Sequence: Synthetic polypeptide
  XENP019331 [CTLA-4]_H0.117_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWIGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4090 - protein, 118 aa, Artificial Sequence; identical to SEQ ID NO: 1237
  Description of Artificial Sequence: Synthetic polypeptide
  VH of XENP019331

SEQ ID NO: 4091 - protein, 5 aa, Artificial Sequence
  Description of Artificial Sequence: Synthetic peptide
  XENP019331 vhCDR1
SYTMH

SEQ ID NO: 4092 - protein, 17 aa, Artificial Sequence
  Description of Artificial Sequence: Synthetic peptide
  XENP019331 vhCDR2
FISYDGNNKYYADSVKG

SEQ ID NO: 4093 - protein, 9 aa, Artificial Sequence
  Description of Artificial Sequence: Synthetic peptide
  XENP019331 vhCDR3
TGWIGPFDY

SEQ ID NO: 4094 - protein, 215 aa, Artificial Sequence; identical to SEQ ID NO: 2924
  Description of Artificial Sequence: Synthetic polypeptide
  XENP019331 [CTLA-4]_H0.117_L0_Fab Light Chain

SEQ ID NO: 4095 - protein, 108 aa, Artificial Sequence; identical to SEQ ID NO: 23
  Description of Artificial Sequence: Synthetic polypeptide
  VL of XENP019331

SEQ ID NO: 4096 - protein, 12 aa, Artificial Sequence
  Description of Artificial Sequence: Synthetic peptide
  XENP019331 vlCDR1
RASQSVGSSYLA

SEQ ID NO: 4097 - protein, 7 aa, Artificial Sequence
  Description of Artificial Sequence: Synthetic peptide
  XENP019331 vlCDR2
GAFSRAT

SEQ ID NO: 4098 - protein, 9 aa, Artificial Sequence
  Description of Artificial Sequence: Synthetic peptide
  XENP019331 vlCDR3
QQYGSSPWT

SEQ ID NO: 4099 - protein, 221 aa, Artificial Sequence
  Description of Artificial Sequence: Synthetic polypeptide
  XENP019332 [CTLA-4]_H0.118_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWVGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4100 - protein, 118 aa, Artificial Sequence; identical to SEQ ID NO: 1246
  Description of Artificial Sequence: Synthetic polypeptide
  VH of XENP019332

SEQ ID NO: 4101 - protein, 5 aa, Artificial Sequence
  Description of Artificial Sequence: Synthetic peptide
  XENP019332 vhCDR1
SYTMH

SEQ ID NO: 4102 - protein, 17 aa, Artificial Sequence
  Description of Artificial Sequence: Synthetic peptide
  XENP019332 vhCDR2
FISYDGNNKYYADSVKG

SEQ ID NO: 4103 - protein, 9 aa, Artificial Sequence
  Description of Artificial Sequence: Synthetic peptide
  XENP019332 vhCDR3
TGWVGPFDY

SEQ ID NO: 4104 - protein, 215 aa, Artificial Sequence; identical to SEQ ID NO: 2924
  Description of Artificial Sequence: Synthetic polypeptide
  XENP019332 [CTLA-4]_H0.118_L0_Fab Light Chain

SEQ ID NO: 4105 - protein, 108 aa, Artificial Sequence; identical to SEQ ID NO: 23
  Description of Artificial Sequence: Synthetic polypeptide
  VL of XENP019332

SEQ ID NO: 4106 - protein, 12 aa, Artificial Sequence
  Description of Artificial Sequence: Synthetic peptide
  XENP019332 vlCDR1
RASQSVGSSYLA

SEQ ID NO: 4107 - protein, 7 aa, Artificial Sequence
  Description of Artificial Sequence: Synthetic peptide
  XENP019332 vlCDR2
GAFSRAT

SEQ ID NO: 4108 - protein, 9 aa, Artificial Sequence
  Description of Artificial Sequence: Synthetic peptide
  XENP019332 vlCDR3
QQYGSSPWT

SEQ ID NO: 4109 - protein, 221 aa, Artificial Sequence
  Description of Artificial Sequence: Synthetic polypeptide
  XENP019333 [CTLA-4]_H0.119_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLAPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4110 - protein, 118 aa, Artificial Sequence; identical to SEQ ID NO: 1255
  Description of Artificial Sequence: Synthetic polypeptide
  VH of XENP019333

SEQ ID NO: 4111 - protein, 5 aa, Artificial Sequence
  Description of Artificial Sequence: Synthetic peptide
  XENP019333 vhCDR1
SYTMH

SEQ ID NO: 4112 - protein, 17 aa, Artificial Sequence
  Description of Artificial Sequence: Synthetic peptide
  XENP019333 vhCDR2
FISYDGNNKYYADSVKG

SEQ ID NO: 4113 - protein, 9 aa, Artificial Sequence
  Description of Artificial Sequence: Synthetic peptide
  XENP019333 vhCDR3
TGWLAPFDY

SEQ ID NO: 4114 - protein, 215 aa, Artificial Sequence; identical to SEQ ID NO: 2924
  Description of Artificial Sequence: Synthetic polypeptide
  XENP019333 [CTLA-4]_H0.119_L0_Fab Light Chain

SEQ ID NO: 4115 - protein, 108 aa, Artificial Sequence; identical to SEQ ID NO: 23
  Description of Artificial Sequence: Synthetic polypeptide
  VL of XENP019333

SEQ ID NO: 4116 - protein, 12 aa, Artificial Sequence
  Description of Artificial Sequence: Synthetic peptide
  XENP019333 vlCDR1
RASQSVGSSYLA

SEQ ID NO: 4117 - protein, 7 aa, Artificial Sequence
  Description of Artificial Sequence: Synthetic peptide
  XENP019333 vlCDR2
GAFSRAT

SEQ ID NO: 4118 - protein, 9 aa, Artificial Sequence
  Description of Artificial Sequence: Synthetic peptide
  XENP019333 vlCDR3
QQYGSSPWT

SEQ ID NO: 4119 - protein, 221 aa, Artificial Sequence
  Description of Artificial Sequence: Synthetic polypeptide
  XENP019334 [CTLA-4]_H0.120_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLSPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4120 - protein, 118 aa, Artificial Sequence; identical to SEQ ID NO: 1264
  Description of Artificial Sequence: Synthetic polypeptide
  VH of XENP019334

SEQ ID NO: 4121 - protein, 5 aa, Artificial Sequence
  Description of Artificial Sequence: Synthetic peptide
  XENP019334 vhCDR1
SYTMH

SEQ ID NO: 4122 - protein, 17 aa, Artificial Sequence
  Description of Artificial Sequence: Synthetic peptide
  XENP019334 vhCDR2
FISYDGNNKYYADSVKG

SEQ ID NO: 4123 - protein, 9 aa, Artificial Sequence
  Description of Artificial Sequence: Synthetic peptide
  XENP019334 vhCDR3
TGWLSPFDY

SEQ ID NO: 4124 - protein, 215 aa, Artificial Sequence; identical to SEQ ID NO: 2924
  Description of Artificial Sequence: Synthetic polypeptide
  XENP019334 [CTLA-4]_H0.120_L0_Fab Light Chain

SEQ ID NO: 4125 - protein, 108 aa, Artificial Sequence; identical to SEQ ID NO: 23
  Description of Artificial Sequence: Synthetic polypeptide
  VL of XENP019334

SEQ ID NO: 4126 - protein, 12 aa, Artificial Sequence
  Description of Artificial Sequence: Synthetic peptide
  XENP019334 vlCDR1
RASQSVGSSYLA

SEQ ID NO: 4127 - protein, 7 aa, Artificial Sequence
  Description of Artificial Sequence: Synthetic peptide
  XENP019334 vlCDR2
GAFSRAT

SEQ ID NO: 4128 - protein, 9 aa, Artificial Sequence
  Description of Artificial Sequence: Synthetic peptide
  XENP019334 vlCDR3
QQYGSSPWT

SEQ ID NO: 4129 - protein, 221 aa, Artificial Sequence
  Description of Artificial Sequence: Synthetic polypeptide
  XENP019335 [CTLA-4]_H0.121_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLTPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4130 - protein, 118 aa, Artificial Sequence; identical to SEQ ID NO: 1273
  Description of Artificial Sequence: Synthetic polypeptide
  VH of XENP019335

SEQ ID NO: 4131 - protein, 5 aa, Artificial Sequence
  Description of Artificial Sequence: Synthetic peptide
  XENP019335 vhCDR1
SYTMH

SEQ ID NO: 4132 - protein, 17 aa, Artificial Sequence
  Description of Artificial Sequence: Synthetic peptide
  XENP019335 vhCDR2
FISYDGNNKYYADSVKG

SEQ ID NO: 4133 - protein, 9 aa, Artificial Sequence
  Description of Artificial Sequence: Synthetic peptide
  XENP019335 vhCDR3
TGWLTPFDY

SEQ ID NO: 4134 - protein, 215 aa, Artificial Sequence; identical to SEQ ID NO: 2924
  Description of Artificial Sequence: Synthetic polypeptide
  XENP019335 [CTLA-4]_H0.121_L0_Fab Light Chain

SEQ ID NO: 4135 - protein, 108 aa, Artificial Sequence; identical to SEQ ID NO: 23
  Description of Artificial Sequence: Synthetic polypeptide
  VL of XENP019335

SEQ ID NO: 4136 - protein, 12 aa, Artificial Sequence
  Description of Artificial Sequence: Synthetic peptide
  XENP019335 vlCDR1
RASQSVGSSYLA

SEQ ID NO: 4137 - protein, 7 aa, Artificial Sequence
  Description of Artificial Sequence: Synthetic peptide
  XENP019335 vlCDR2
GAFSRAT

SEQ ID NO: 4138 - protein, 9 aa, Artificial Sequence
  Description of Artificial Sequence: Synthetic peptide
  XENP019335 vlCDR3
QQYGSSPWT

SEQ ID NO: 4139 - protein, 221 aa, Artificial Sequence
  Description of Artificial Sequence: Synthetic polypeptide
  XENP019336 [CTLA-4]_H0.122_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4140 - protein, 118 aa, Artificial Sequence; identical to SEQ ID NO: 1282
  Description of Artificial Sequence: Synthetic polypeptide
  VH of XENP019336

SEQ ID NO: 4141 - protein, 5 aa, Artificial Sequence
  Description of Artificial Sequence: Synthetic peptide
  XENP019336 vhCDR1
SYTMH

SEQ ID NO: 4142 - protein, 17 aa, Artificial Sequence
  Description of Artificial Sequence: Synthetic peptide
  XENP019336 vhCDR2
FISYDGNNKYYADSVKG

SEQ ID NO: 4143 - protein, 9 aa, Artificial Sequence
  Description of Artificial Sequence: Synthetic peptide
  XENP019336 vhCDR3
TGWLGPLDY

SEQ ID NO: 4144 - protein, 215 aa, Artificial Sequence; identical to SEQ ID NO: 2924
  Description of Artificial Sequence: Synthetic polypeptide
  XENP019336 [CTLA-4]_H0.122_L0_Fab Light Chain

SEQ ID NO: 4145 - protein, 108 aa, Artificial Sequence; identical to SEQ ID NO: 23
  Description of Artificial Sequence: Synthetic polypeptide
  VL of XENP019336

SEQ ID NO: 4146 - protein, 12 aa, Artificial Sequence
  Description of Artificial Sequence: Synthetic peptide
  XENP019336 vlCDR1
RASQSVGSSYLA

SEQ ID NO: 4147 - protein, 7 aa, Artificial Sequence
  Description of Artificial Sequence: Synthetic peptide
  XENP019336 vlCDR2
GAFSRAT

SEQ ID NO: 4148 - protein, 9 aa, Artificial Sequence
  Description of Artificial Sequence: Synthetic peptide
  XENP019336 vlCDR3
QQYGSSPWT

SEQ ID NO: 4149 - protein, 221 aa, Artificial Sequence
  Description of Artificial Sequence: Synthetic polypeptide
  XENP019337 [CTLA-4]_H0.123_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4150 - protein, 118 aa, Artificial Sequence; identical to SEQ ID NO: 1291
  Description of Artificial Sequence: Synthetic polypeptide
  VH of XENP019337

SEQ ID NO: 4151 - protein, 5 aa, Artificial Sequence
  Description of Artificial Sequence: Synthetic peptide
  XENP019337 vhCDR1
SYTMH

SEQ ID NO: 4152 - protein, 17 aa, Artificial Sequence
  Description of Artificial Sequence: Synthetic peptide
  XENP019337 vhCDR2
FISYDGNNKYYADSVKG

SEQ ID NO: 4153 - protein, 9 aa, Artificial Sequence
  Description of Artificial Sequence: Synthetic peptide
  XENP019337 vhCDR3
TGWLGPMDY

SEQ ID NO: 4154 - protein, 215 aa, Artificial Sequence; identical to SEQ ID NO: 2924
  Description of Artificial Sequence: Synthetic polypeptide
  XENP019337 [CTLA-4]_H0.123_L0_Fab Light Chain

SEQ ID NO: 4155 - protein, 108 aa, Artificial Sequence; identical to SEQ ID NO: 23
  Description of Artificial Sequence: Synthetic polypeptide
  VL of XENP019337

SEQ ID NO: 4156 - protein, 12 aa, Artificial Sequence
  Description of Artificial Sequence: Synthetic peptide
  XENP019337 vlCDR1
RASQSVGSSYLA

SEQ ID NO: 4157 - protein, 7 aa, Artificial Sequence
  Description of Artificial Sequence: Synthetic peptide
  XENP019337 vlCDR2
GAFSRAT

SEQ ID NO: 4158 - protein, 9 aa, Artificial Sequence
  Description of Artificial Sequence: Synthetic peptide
  XENP019337 vlCDR3
QQYGSSPWT

SEQ ID NO: 4159 - protein, 221 aa, Artificial Sequence
  Description of Artificial Sequence: Synthetic polypeptide
  XENP019338 [CTLA-4]_H0.124_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4160 - protein, 118 aa, Artificial Sequence; identical to SEQ ID NO: 1300
  Description of Artificial Sequence: Synthetic polypeptide
  VH of XENP019338

SEQ ID NO: 4161 - protein, 5 aa, Artificial Sequence
  Description of Artificial Sequence: Synthetic peptide
  XENP019338 vhCDR1
SYTMH

SEQ ID NO: 4162 - protein, 17 aa, Artificial Sequence
  Description of Artificial Sequence: Synthetic peptide
  XENP019338 vhCDR2
FISYDGNNKYYADSVKG

SEQ ID NO: 4163 - protein, 9 aa, Artificial Sequence
  Description of Artificial Sequence: Synthetic peptide
  XENP019338 vhCDR3
TGWLGPFAY

SEQ ID NO: 4164 - protein, 215 aa, Artificial Sequence; identical to SEQ ID NO: 2924
  Description of Artificial Sequence: Synthetic polypeptide
  XENP019338 [CTLA-4]_H0.124_L0_Fab Light Chain

SEQ ID NO: 4165 - protein, 108 aa, Artificial Sequence; identical to SEQ ID NO: 23
  Description of Artificial Sequence: Synthetic polypeptide
  VL of XENP019338

SEQ ID NO: 4166 - protein, 12 aa, Artificial Sequence
  Description of Artificial Sequence: Synthetic peptide
  XENP019338 vlCDR1
RASQSVGSSYLA

SEQ ID NO: 4167 - protein, 7 aa, Artificial Sequence
  Description of Artificial Sequence: Synthetic peptide
  XENP019338 vlCDR2
GAFSRAT

SEQ ID NO: 4168 - protein, 9 aa, Artificial Sequence
  Description of Artificial Sequence: Synthetic peptide
  XENP019338 vlCDR3
QQYGSSPWT

SEQ ID NO: 4169 - protein, 221 aa, Artificial Sequence
  Description of Artificial Sequence: Synthetic polypeptide
  XENP019339 [CTLA-4]_H0.125_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFEYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4170 - protein, 118 aa, Artificial Sequence; identical to SEQ ID NO: 1309
  Description of Artificial Sequence: Synthetic polypeptide
  VH of XENP019339

SEQ ID NO: 4171 - protein, 5 aa, Artificial Sequence
  Description of Artificial Sequence: Synthetic peptide
  XENP019339 vhCDR1
SYTMH

SEQ ID NO: 4172 - protein, 17 aa, Artificial Sequence
  Description of Artificial Sequence: Synthetic peptide
  XENP019339 vhCDR2
FISYDGNNKYYADSVKG

SEQ ID NO: 4173 - protein, 9 aa, Artificial Sequence
  Description of Artificial Sequence: Synthetic peptide
  XENP019339 vhCDR3
TGWLGPFEY

SEQ ID NO: 4174 - protein, 215 aa, Artificial Sequence; identical to SEQ ID NO: 2924
  Description of Artificial Sequence: Synthetic polypeptide
  XENP019339 [CTLA-4]_H0.125_L0_Fab Light Chain

SEQ ID NO: 4175 - protein, 108 aa, Artificial Sequence; identical to SEQ ID NO: 23
  Description of Artificial Sequence: Synthetic polypeptide
  VL of XENP019339

SEQ ID NO: 4176 - protein, 12 aa, Artificial Sequence
  Description of Artificial Sequence: Synthetic peptide
  XENP019339 vlCDR1
RASQSVGSSYLA

SEQ ID NO: 4177 - protein, 7 aa, Artificial Sequence
  Description of Artificial Sequence: Synthetic peptide
  XENP019339 vlCDR2
GAFSRAT

SEQ ID NO: 4178 - protein, 9 aa, Artificial Sequence
  Description of Artificial Sequence: Synthetic peptide
  XENP019339 vlCDR3
QQYGSSPWT

SEQ ID NO: 4179 - protein, 221 aa, Artificial Sequence
  Description of Artificial Sequence: Synthetic polypeptide
  XENP019340 [CTLA-4]_H0.126_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFHYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4180 - protein, 118 aa, Artificial Sequence; identical to SEQ ID NO: 1318
  Description of Artificial Sequence: Synthetic polypeptide
  VH of XENP019340

SEQ ID NO: 4181 - protein, 5 aa, Artificial Sequence
  Description of Artificial Sequence: Synthetic peptide
  XENP019340 vhCDR1
SYTMH

SEQ ID NO: 4182 - protein, 17 aa, Artificial Sequence
  Description of Artificial Sequence: Synthetic peptide
  XENP019340 vhCDR2
FISYDGNNKYYADSVKG

SEQ ID NO: 4183 - protein, 9 aa, Artificial Sequence
  Description of Artificial Sequence: Synthetic peptide
  XENP019340 vhCDR3
TGWLGPFHY

SEQ ID NO: 4184 - protein, 215 aa, Artificial Sequence; identical to SEQ ID NO: 2924
  Description of Artificial Sequence: Synthetic polypeptide
  XENP019340 [CTLA-4]_H0.126_L0_Fab Light Chain

SEQ ID NO: 4185 - protein, 108 aa, Artificial Sequence; identical to SEQ ID NO: 23
  Description of Artificial Sequence: Synthetic polypeptide
  VL of XENP019340

SEQ ID NO: 4186 - protein, 12 aa, Artificial Sequence
  Description of Artificial Sequence: Synthetic peptide
  XENP019340 vlCDR1
RASQSVGSSYLA

SEQ ID NO: 4187 - protein, 7 aa, Artificial Sequence
  Description of Artificial Sequence: Synthetic peptide
  XENP019340 vlCDR2
GAFSRAT

SEQ ID NO: 4188 - protein, 9 aa, Artificial Sequence
  Description of Artificial Sequence: Synthetic peptide
  XENP019340 vlCDR3
QQYGSSPWT

SEQ ID NO: 4189 - protein, 221 aa, Artificial Sequence
  Description of Artificial Sequence: Synthetic polypeptide
  XENP019341 [CTLA-4]_H0.127_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFNYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4190 - protein, 118 aa, Artificial Sequence; identical to SEQ ID NO: 1327
  Description of Artificial Sequence: Synthetic polypeptide
  VH of XENP019341

SEQ ID NO: 4191 - protein, 5 aa, Artificial Sequence
  Description of Artificial Sequence: Synthetic peptide
  XENP019341 vhCDR1
SYTMH

SEQ ID NO: 4192 - protein, 17 aa, Artificial Sequence
  Description of Artificial Sequence: Synthetic peptide
  XENP019341 vhCDR2
FISYDGNNKYYADSVKG

SEQ ID NO: 4193 - protein, 9 aa, Artificial Sequence
  Description of Artificial Sequence: Synthetic peptide
  XENP019341 vhCDR3
TGWLGPFNY

SEQ ID NO: 4194 - protein, 215 aa, Artificial Sequence; identical to SEQ ID NO: 2924
  Description of Artificial Sequence: Synthetic polypeptide
  XENP019341 [CTLA-4]_H0.127_L0_Fab Light Chain

SEQ ID NO: 4195 - protein, 108 aa, Artificial Sequence; identical to SEQ ID NO: 23
  Description of Artificial Sequence: Synthetic polypeptide
  VL of XENP019341

SEQ ID NO: 4196 - protein, 12 aa, Artificial Sequence
  Description of Artificial Sequence: Synthetic peptide
  XENP019341 vlCDR1
RASQSVGSSYLA

SEQ ID NO: 4197 - protein, 7 aa, Artificial Sequence
  Description of Artificial Sequence: Synthetic peptide
  XENP019341 vlCDR2
GAFSRAT

SEQ ID NO: 4198 - protein, 9 aa, Artificial Sequence
  Description of Artificial Sequence: Synthetic peptide
  XENP019341 vlCDR3
QQYGSSPWT

SEQ ID NO: 4199 - protein, 221 aa, Artificial Sequence
  Description of Artificial Sequence: Synthetic polypeptide
  XENP019342 [CTLA-4]_H0.128_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFSYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4200 - protein, 118 aa, Artificial Sequence; identical to SEQ ID NO: 1336
  Description of Artificial Sequence: Synthetic polypeptide
  VH of XENP019342

SEQ ID NO: 4201 - protein, 5 aa, Artificial Sequence
  Description of Artificial Sequence: Synthetic peptide
  XENP019342 vhCDR1
SYTMH

SEQ ID NO: 4202 - protein, 17 aa, Artificial Sequence
  Description of Artificial Sequence: Synthetic peptide
  XENP019342 vhCDR2
FISYDGNNKYYADSVKG

SEQ ID NO: 4203 - protein, 9 aa, Artificial Sequence
  Description of Artificial Sequence: Synthetic peptide
  XENP019342 vhCDR3
TGWLGPFSY

SEQ ID NO: 4204 - protein, 215 aa, Artificial Sequence; identical to SEQ ID NO: 2924
  Description of Artificial Sequence: Synthetic polypeptide
  XENP019342 [CTLA-4]_H0.128_L0_Fab Light Chain

SEQ ID NO: 4205 - protein, 108 aa, Artificial Sequence; identical to SEQ ID NO: 23
  Description of Artificial Sequence: Synthetic polypeptide
  VL of XENP019342

SEQ ID NO: 4206 - protein, 12 aa, Artificial Sequence
  Description of Artificial Sequence: Synthetic peptide
  XENP019342 vlCDR1
RASQSVGSSYLA

SEQ ID NO: 4207 - protein, 7 aa, Artificial Sequence
  Description of Artificial Sequence: Synthetic peptide
  XENP019342 vlCDR2
GAFSRAT

SEQ ID NO: 4208 - protein, 9 aa, Artificial Sequence
  Description of Artificial Sequence: Synthetic peptide
  XENP019342 vlCDR3
QQYGSSPWT

SEQ ID NO: 4209 - protein, 221 aa, Artificial Sequence
  Description of Artificial Sequence: Synthetic polypeptide
  XENP019343 [CTLA-4]_H0.129_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFQYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4210 - protein, 118 aa, Artificial Sequence; identical to SEQ ID NO: 1345
  Description of Artificial Sequence: Synthetic polypeptide
  VH of XENP019343

SEQ ID NO: 4211 - protein, 5 aa, Artificial Sequence
  Description of Artificial Sequence: Synthetic peptide
  XENP019343 vhCDR1
SYTMH

SEQ ID NO: 4212 - protein, 17 aa, Artificial Sequence
  Description of Artificial Sequence: Synthetic peptide
  XENP019343 vhCDR2
FISYDGNNKYYADSVKG

SEQ ID NO: 4213 - protein, 9 aa, Artificial Sequence
  Description of Artificial Sequence: Synthetic peptide
  XENP019343 vhCDR3
TGWLGPFQY

SEQ ID NO: 4214 - protein, 215 aa, Artificial Sequence; identical to SEQ ID NO: 2924
  Description of Artificial Sequence: Synthetic polypeptide
  XENP019343 [CTLA-4]_H0.129_L0_Fab Light Chain

SEQ ID NO: 4215 - protein, 108 aa, Artificial Sequence; identical to SEQ ID NO: 23
  Description of Artificial Sequence: Synthetic polypeptide
  VL of XENP019343

SEQ ID NO: 4216 - protein, 12 aa, Artificial Sequence
  Description of Artificial Sequence: Synthetic peptide
  XENP019343 vlCDR1
RASQSVGSSYLA

SEQ ID NO: 4217 - protein, 7 aa, Artificial Sequence
  Description of Artificial Sequence: Synthetic peptide
  XENP019343 vlCDR2
GAFSRAT

SEQ ID NO: 4218 - protein, 9 aa, Artificial Sequence
  Description of Artificial Sequence: Synthetic peptide
  XENP019343 vlCDR3
QQYGSSPWT

SEQ ID NO: 4219 - protein, 221 aa, Artificial Sequence
  Description of Artificial Sequence: Synthetic polypeptide
  XENP019344 [CTLA-4]_H0.130_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4220 - protein, 118 aa, Artificial Sequence; identical to SEQ ID NO: 1354
  Description of Artificial Sequence: Synthetic polypeptide
  VH of XENP019344

SEQ ID NO: 4221 - protein, 5 aa, Artificial Sequence
  Description of Artificial Sequence: Synthetic peptide
  XENP019344 vhCDR1
SYTMH

SEQ ID NO: 4222 - protein, 17 aa, Artificial Sequence
  Description of Artificial Sequence: Synthetic peptide
  XENP019344 vhCDR2
FISYDGNNKYYADSVKG

SEQ ID NO: 4223 - protein, 9 aa, Artificial Sequence
  Description of Artificial Sequence: Synthetic peptide
  XENP019344 vhCDR3
TGWLGPFDH

SEQ ID NO: 4224 - protein, 215 aa, Artificial Sequence; identical to SEQ ID NO: 2924
  Description of Artificial Sequence: Synthetic polypeptide
  XENP019344 [CTLA-4]_H0.130_L0_Fab Light Chain

SEQ ID NO: 4225 - protein, 108 aa, Artificial Sequence; identical to SEQ ID NO: 23
  Description of Artificial Sequence: Synthetic polypeptide
  VL of XENP019344

SEQ ID NO: 4226 - protein, 12 aa, Artificial Sequence
  Description of Artificial Sequence: Synthetic peptide
  XENP019344 vlCDR1
RASQSVGSSYLA

SEQ ID NO: 4227 - protein, 7 aa, Artificial Sequence
  Description of Artificial Sequence: Synthetic peptide
  XENP019344 vlCDR2
GAFSRAT

SEQ ID NO: 4228 - protein, 9 aa, Artificial Sequence
  Description of Artificial Sequence: Synthetic peptide
  XENP019344 vlCDR3
QQYGSSPWT

SEQ ID NO: 4229 - protein, 221 aa, Artificial Sequence
  Description of Artificial Sequence: Synthetic polypeptide
  XENP019345 [CTLA-4]_H0.131_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4230 - protein, 118 aa, Artificial Sequence; identical to SEQ ID NO: 1363
  Description of Artificial Sequence: Synthetic polypeptide
  VH of XENP019345

SEQ ID NO: 4231 - protein, 5 aa, Artificial Sequence
  Description of Artificial Sequence: Synthetic peptide
  XENP019345 vhCDR1
SYTMH

SEQ ID NO: 4232 - protein, 17 aa, Artificial Sequence
  Description of Artificial Sequence: Synthetic peptide
  XENP019345 vhCDR2
FISYDGNNKYYADSVKG

SEQ ID NO: 4233 - protein, 9 aa, Artificial Sequence
  Description of Artificial Sequence: Synthetic peptide
  XENP019345 vhCDR3
TGWLGPFDL

SEQ ID NO: 4234 - protein, 215 aa, Artificial Sequence; identical to SEQ ID NO: 2924
  Description of Artificial Sequence: Synthetic polypeptide
  XENP019345 [CTLA-4]_H0.131_L0_Fab Light Chain

SEQ ID NO: 4235 - protein, 108 aa, Artificial Sequence; identical to SEQ ID NO: 23
  Description of Artificial Sequence: Synthetic polypeptide
  VL of XENP019345

SEQ ID NO: 4236 - protein, 12 aa, Artificial Sequence
  Description of Artificial Sequence: Synthetic peptide
  XENP019345 vlCDR1
RASQSVGSSYLA

SEQ ID NO: 4237 - protein, 7 aa, Artificial Sequence
  Description of Artificial Sequence: Synthetic peptide
  XENP019345 vlCDR2
GAFSRAT

SEQ ID NO: 4238 - protein, 9 aa, Artificial Sequence
  Description of Artificial Sequence: Synthetic peptide
  XENP019345 vlCDR3
QQYGSSPWT

SEQ ID NO: 4239 - protein, 221 aa, Artificial Sequence
  Description of Artificial Sequence: Synthetic polypeptide
  XENP019346 [CTLA-4]_H0.132_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4240 - protein, 118 aa, Artificial Sequence; identical to SEQ ID NO: 1372
  Description of Artificial Sequence: Synthetic polypeptide
  VH of XENP019346

SEQ ID NO: 4241 - protein, 5 aa, Artificial Sequence
  Description of Artificial Sequence: Synthetic peptide
  XENP019346 vhCDR1
SYTMH

SEQ ID NO: 4242 - protein, 17 aa, Artificial Sequence
  Description of Artificial Sequence: Synthetic peptide
  XENP019346 vhCDR2
FISYDGNNKYYADSVKG

SEQ ID NO: 4243 - protein, 9 aa, Artificial Sequence
  Description of Artificial Sequence: Synthetic peptide
  XENP019346 vhCDR3
TGWLGPFDS

SEQ ID NO: 4244 - protein, 215 aa, Artificial Sequence; identical to SEQ ID NO: 2924
  Description of Artificial Sequence: Synthetic polypeptide
  XENP019346 [CTLA-4]_H0.132_L0_Fab Light Chain

SEQ ID NO: 4245 - protein, 108 aa, Artificial Sequence; identical to SEQ ID NO: 23
  Description of Artificial Sequence: Synthetic polypeptide
  VL of XENP019346

SEQ ID NO: 4246 - protein, 12 aa, Artificial Sequence
  Description of Artificial Sequence: Synthetic peptide
  XENP019346 vlCDR1
RASQSVGSSYLA

SEQ ID NO: 4247 - protein, 7 aa, Artificial Sequence
  Description of Artificial Sequence: Synthetic peptide
  XENP019346 vlCDR2
GAFSRAT

SEQ ID NO: 4248 - protein, 9 aa, Artificial Sequence
  Description of Artificial Sequence: Synthetic peptide
  XENP019346 vlCDR3
QQYGSSPWT

SEQ ID NO: 4249 - protein, 221 aa, Artificial Sequence
  Description of Artificial Sequence: Synthetic polypeptide
  XENP019347 [CTLA-4]_H0.133_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4250 - protein, 118 aa, Artificial Sequence; identical to SEQ ID NO: 1381
  Description of Artificial Sequence: Synthetic polypeptide
  VH of XENP019347

SEQ ID NO: 4251 - protein, 5 aa, Artificial Sequence
  Description of Artificial Sequence: Synthetic peptide
  XENP019347 vhCDR1
SYTMH

SEQ ID NO: 4252 - protein, 17 aa, Artificial Sequence
  Description of Artificial Sequence: Synthetic peptide
  XENP019347 vhCDR2
FISYDGNNKYYADSVKG

SEQ ID NO: 4253 - protein, 9 aa, Artificial Sequence
  Description of Artificial Sequence: Synthetic peptide
  XENP019347 vhCDR3
TGWLGPFDV

SEQ ID NO: 4254 - protein, 215 aa, Artificial Sequence; identical to SEQ ID NO: 2924
  Description of Artificial Sequence: Synthetic polypeptide
  XENP019347 [CTLA-4]_H0.133_L0_Fab Light Chain

SEQ ID NO: 4255 - protein, 108 aa, Artificial Sequence; identical to SEQ ID NO: 23
  Description of Artificial Sequence: Synthetic polypeptide
  VL of XENP019347

SEQ ID NO: 4256 - protein, 12 aa, Artificial Sequence
  Description of Artificial Sequence: Synthetic peptide
  XENP019347 vlCDR1
RASQSVGSSYLA

SEQ ID NO: 4257 - protein, 7 aa, Artificial Sequence
  Description of Artificial Sequence: Synthetic peptide
  XENP019347 vlCDR2
GAFSRAT

SEQ ID NO: 4258 - protein, 9 aa, Artificial Sequence
  Description of Artificial Sequence: Synthetic peptide
  XENP019347 vlCDR3
QQYGSSPWT

SEQ ID NO: 4259 - protein, 221 aa, Artificial Sequence
  Description of Artificial Sequence: Synthetic polypeptide
  XENP019348 [CTLA-4]_H0.134_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4260 - protein, 118 aa, Artificial Sequence; identical to SEQ ID NO: 67
  Description of Artificial Sequence: Synthetic polypeptide
  VH of XENP019348

SEQ ID NO: 4261 - protein, 5 aa, Artificial Sequence
  Description of Artificial Sequence: Synthetic peptide
  XENP019348 vhCDR1
SYTMH

SEQ ID NO: 4262 - protein, 17 aa, Artificial Sequence
  Description of Artificial Sequence: Synthetic peptide
  XENP019348 vhCDR2
FISYDGNNKYYADSVKG

SEQ ID NO: 4263 - protein, 9 aa, Artificial Sequence
  Description of Artificial Sequence: Synthetic peptide
  XENP019348 vhCDR3
TGWLGPFDY

SEQ ID NO: 4264 - protein, 215 aa, Artificial Sequence; identical to SEQ ID NO: 2924
  Description of Artificial Sequence: Synthetic polypeptide
  XENP019348 [CTLA-4]_H0.134_L0_Fab Light Chain

SEQ ID NO: 4265 - protein, 108 aa, Artificial Sequence; identical to SEQ ID NO: 23
  Description of Artificial Sequence: Synthetic polypeptide
  VL of XENP019348

SEQ ID NO: 4266 - protein, 12 aa, Artificial Sequence
  Description of Artificial Sequence: Synthetic peptide
  XENP019348 vlCDR1
RASQSVGSSYLA

SEQ ID NO: 4267 - protein, 7 aa, Artificial Sequence
  Description of Artificial Sequence: Synthetic peptide
  XENP019348 vlCDR2
GAFSRAT

SEQ ID NO: 4268 - protein, 9 aa, Artificial Sequence
  Description of Artificial Sequence: Synthetic peptide
  XENP019348 vlCDR3
QQYGSSPWT

SEQ ID NO: 4269 - protein, 221 aa, Artificial Sequence
  Description of Artificial Sequence: Synthetic polypeptide
  XENP019349 [CTLA-4]_H0.135_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4270 - protein, 118 aa, Artificial Sequence; identical to SEQ ID NO: 1399
  Description of Artificial Sequence: Synthetic polypeptide
  VH of XENP019349

SEQ ID NO: 4271 - protein, 5 aa, Artificial Sequence
  Description of Artificial Sequence: Synthetic peptide
  XENP019349 vhCDR1
SYTMH

SEQ ID NO: 4272 - protein, 17 aa, Artificial Sequence
  Description of Artificial Sequence: Synthetic peptide
  XENP019349 vhCDR2
FISYDGNNKYYADSVKG

SEQ ID NO: 4273 - protein, 9 aa, Artificial Sequence
  Description of Artificial Sequence: Synthetic peptide
  XENP019349 vhCDR3
TGWLGPFDY

SEQ ID NO: 4274 - protein, 215 aa, Artificial Sequence; identical to SEQ ID NO: 2924
  Description of Artificial Sequence: Synthetic polypeptide
  XENP019349 [CTLA-4]_H0.135_L0_Fab Light Chain

SEQ ID NO: 4275 - protein, 108 aa, Artificial Sequence; identical to SEQ ID NO: 23
  Description of Artificial Sequence: Synthetic polypeptide
  VL of XENP019349

SEQ ID NO: 4276 - protein, 12 aa, Artificial Sequence
  Description of Artificial Sequence: Synthetic peptide
  XENP019349 vlCDR1
RASQSVGSSYLA

SEQ ID NO: 4277 - protein, 7 aa, Artificial Sequence
  Description of Artificial Sequence: Synthetic peptide
  XENP019349 vlCDR2
GAFSRAT

SEQ ID NO: 4278 - protein, 9 aa, Artificial Sequence
  Description of Artificial Sequence: Synthetic peptide
  XENP019349 vlCDR3
QQYGSSPWT

SEQ ID NO: 4279 - protein, 221 aa, Artificial Sequence
  Description of Artificial Sequence: Synthetic polypeptide
  XENP019350 [CTLA-4]_H0.136_L0_Fab Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4280 - protein, 118 aa, Artificial Sequence; identical to SEQ ID NO: 1408
  Description of Artificial Sequence: Synthetic polypeptide
  VH of XENP019350

SEQ ID NO: 4281 - protein, 5 aa, Artificial Sequence
  Description of Artificial Sequence: Synthetic peptide
  XENP019350 vhCDR1
SYTMH

SEQ ID NO: 4282 - protein, 17 aa, Artificial Sequence
  Description of Artificial Sequence: Synthetic peptide
  XENP019350 vhCDR2
FISYDGNNKYYADSVKG

SEQ ID NO: 4283 - protein, 9 aa, Artificial Sequence
  Description of Artificial Sequence: Synthetic peptide
  XENP019350 vhCDR3
TGWLGPFDY

SEQ ID NO: 4284 - protein, 215 aa, Artificial Sequence; identical to SEQ ID NO: 2924
  Description of Artificial Sequence: Synthetic polypeptide
  XENP019350 [CTLA-4]_H0.136_L0_Fab Light Chain

SEQ ID NO: 4285 - protein, 108 aa, Artificial Sequence; identical to SEQ ID NO: 23
  Description of Artificial Sequence: Synthetic polypeptide
  VL of XENP019350

SEQ ID NO: 4286 - protein, 12 aa, Artificial Sequence
  Description of Artificial Sequence: Synthetic peptide
  XENP019350 vlCDR1
RASQSVGSSYLA

SEQ ID NO: 4287 - protein, 7 aa, Artificial Sequence
  Description of Artificial Sequence: Synthetic peptide
  XENP019350 vlCDR2
GAFSRAT

SEQ ID NO: 4288 - protein, 9 aa, Artificial Sequence
  Description of Artificial Sequence: Synthetic peptide
  XENP019350 vlCDR3
QQYGSSPWT

SEQ ID NO: 4289 - protein, 221 aa, Artificial Sequence; identical to SEQ ID NO: 2919
  Description of Artificial Sequence: Synthetic polypeptide
  XENP019416 [CTLA-4]_H0_L0.1_Fab Heavy Chain

SEQ ID NO: 4290 - protein, 118 aa, Artificial Sequence; identical to SEQ ID NO: 22
  Description of Artificial Sequence: Synthetic polypeptide
  VH of XENP019416

SEQ ID NO: 4291 - protein, 5 aa, Artificial Sequence
  Description of Artificial Sequence: Synthetic peptide
  XENP019416 vhCDR1
SYTMH

SEQ ID NO: 4292 - protein, 17 aa, Artificial Sequence
  Description of Artificial Sequence: Synthetic peptide
  XENP019416 vhCDR2
FISYDGNNKYYADSVKG

SEQ ID NO: 4293 - protein, 9 aa, Artificial Sequence
  Description of Artificial Sequence: Synthetic peptide
  XENP019416 vhCDR3
TGWLGPFDY

SEQ ID NO: 4294 - protein, 215 aa, Artificial Sequence
  Description of Artificial Sequence: Synthetic polypeptide
  XENP019416 [CTLA-4]_H0_L0.1_Fab Light Chain
AIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4295 - protein, 108 aa, Artificial Sequence; identical to SEQ ID NO: 1418
  Description of Artificial Sequence: Synthetic polypeptide
  VL of XENP019416

SEQ ID NO: 4296 - protein, 12 aa, Artificial Sequence
  Description of Artificial Sequence: Synthetic peptide
  XENP019416 vlCDR1
RASQSVGSSYLA

SEQ ID NO: 4297 - protein, 7 aa, Artificial Sequence
  Description of Artificial Sequence: Synthetic peptide
  XENP019416 vlCDR2
GAFSRAT

SEQ ID NO: 4298 - protein, 9 aa, Artificial Sequence
  Description of Artificial Sequence: Synthetic peptide
  XENP019416 vlCDR3
QQYGSSPWT

SEQ ID NO: 4299 - protein, 221 aa, Artificial Sequence; identical to SEQ ID NO: 2919
  Description of Artificial Sequence: Synthetic polypeptide
  XENP019417 [CTLA-4]_H0_L0.2_Fab Heavy Chain

SEQ ID NO: 4300 - protein, 118 aa, Artificial Sequence; identical to SEQ ID NO: 22
  Description of Artificial Sequence: Synthetic polypeptide
  VH of XENP019417

SEQ ID NO: 4301 - protein, 5 aa, Artificial Sequence
  Description of Artificial Sequence: Synthetic peptide
  XENP019417 vhCDR1
SYTMH

SEQ ID NO: 4302 - protein, 17 aa, Artificial Sequence
  Description of Artificial Sequence: Synthetic peptide
  XENP019417 vhCDR2
FISYDGNNKYYADSVKG

SEQ ID NO: 4303 - protein, 9 aa, Artificial Sequence
  Description of Artificial Sequence: Synthetic peptide
  XENP019417 vhCDR3
TGWLGPFDY

SEQ ID NO: 4304 - protein, 215 aa, Artificial Sequence
  Description of Artificial Sequence: Synthetic polypeptide
  XENP019417 [CTLA-4]_H0_L0.2_Fab Light Chain
DIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4305 - protein, 108 aa, Artificial Sequence; identical to SEQ ID NO: 1427
  Description of Artificial Sequence: Synthetic polypeptide
  VL of XENP019417

SEQ ID NO: 4306 - protein, 12 aa, Artificial Sequence
  Description of Artificial Sequence: Synthetic peptide
  XENP019417 vlCDR1
RASQSVGSSYLA

SEQ ID NO: 4307 - protein, 7 aa, Artificial Sequence
  Description of Artificial Sequence: Synthetic peptide
  XENP019417 vlCDR2
GAFSRAT

SEQ ID NO: 4308 - protein, 9 aa, Artificial Sequence
  Description of Artificial Sequence: Synthetic peptide
  XENP019417 vlCDR3
QQYGSSPWT

SEQ ID NO: 4309 - protein, 221 aa, Artificial Sequence; identical to SEQ ID NO: 2919
  Description of Artificial Sequence: Synthetic polypeptide
  XENP019418 [CTLA-4]_H0_L0.3_Fab Heavy Chain

SEQ ID NO: 4310 - protein, 118 aa, Artificial Sequence; identical to SEQ ID NO: 22
  Description of Artificial Sequence: Synthetic polypeptide
  VH of XENP019418

SEQ ID NO: 4311 - protein, 5 aa, Artificial Sequence
  Description of Artificial Sequence: Synthetic peptide
  XENP019418 vhCDR1
SYTMH

SEQ ID NO: 4312 - protein, 17 aa, Artificial Sequence
  Description of Artificial Sequence: Synthetic peptide
  XENP019418 vhCDR2
FISYDGNNKYYADSVKG

SEQ ID NO: 4313 - protein, 9 aa, Artificial Sequence
  Description of Artificial Sequence: Synthetic peptide
  XENP019418 vhCDR3
TGWLGPFDY

SEQ ID NO: 4314 - protein, 215 aa, Artificial Sequence
  Description of Artificial Sequence: Synthetic polypeptide
  XENP019418 [CTLA-4]_H0_L0.3_Fab Light Chain
QIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4315 - protein, 108 aa, Artificial Sequence; identical to SEQ ID NO: 1436
  Description of Artificial Sequence: Synthetic polypeptide
  VL of XENP019418

SEQ ID NO: 4316 - protein, 12 aa, Artificial Sequence
  Description of Artificial Sequence: Synthetic peptide
  XENP019418 vlCDR1
RASQSVGSSYLA

SEQ ID NO: 4317 - protein, 7 aa, Artificial Sequence
  Description of Artificial Sequence: Synthetic peptide
  XENP019418 vlCDR2
GAFSRAT

SEQ ID NO: 4318 - protein, 9 aa, Artificial Sequence
  Description of Artificial Sequence: Synthetic peptide
  XENP019418 vlCDR3
QQYGSSPWT

SEQ ID NO: 4319 - protein, 221 aa, Artificial Sequence; identical to SEQ ID NO: 2919
  Description of Artificial Sequence: Synthetic polypeptide
  XENP019419 [CTLA-4]_H0_L0.4_Fab Heavy Chain

SEQ ID NO: 4320 - protein, 118 aa, Artificial Sequence; identical to SEQ ID NO: 22
  Description of Artificial Sequence: Synthetic polypeptide
  VH of XENP019419

SEQ ID NO: 4321 - protein, 5 aa, Artificial Sequence
  Description of Artificial Sequence: Synthetic peptide
  XENP019419 vhCDR1
SYTMH

SEQ ID NO: 4322 - protein, 17 aa, Artificial Sequence
  Description of Artificial Sequence: Synthetic peptide
  XENP019419 vhCDR2
FISYDGNNKYYADSVKG

SEQ ID NO: 4323 - protein, 9 aa, Artificial Sequence
  Description of Artificial Sequence: Synthetic peptide
  XENP019419 vhCDR3
TGWLGPFDY

SEQ ID NO: 4324 - protein, 215 aa, Artificial Sequence
  Description of Artificial Sequence: Synthetic polypeptide
  XENP019419 [CTLA-4]_H0_L0.4_Fab Light Chain
RIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4325 - protein, 108 aa, Artificial Sequence; identical to SEQ ID NO: 1445
  Description of Artificial Sequence: Synthetic polypeptide
  VL of XENP019419

SEQ ID NO: 4326 - protein, 12 aa, Artificial Sequence
  Description of Artificial Sequence: Synthetic peptide
  XENP019419 vlCDR1
RASQSVGSSYLA

SEQ ID NO: 4327 - protein, 7 aa, Artificial Sequence
  Description of Artificial Sequence: Synthetic peptide
  XENP019419 vlCDR2
GAFSRAT

SEQ ID NO: 4328 - protein, 9 aa, Artificial Sequence
  Description of Artificial Sequence: Synthetic peptide
  XENP019419 vlCDR3
QQYGSSPWT

SEQ ID NO: 4329 - protein, 221 aa, Artificial Sequence; identical to SEQ ID NO: 2919
  Description of Artificial Sequence: Synthetic polypeptide
  XENP019420 [CTLA-4]_H0_L0.5_Fab Heavy Chain

SEQ ID NO: 4330 - protein, 118 aa, Artificial Sequence; identical to SEQ ID NO: 22
  Description of Artificial Sequence: Synthetic polypeptide
  VH of XENP019420

SEQ ID NO: 4331 - protein, 5 aa, Artificial Sequence
  Description of Artificial Sequence: Synthetic peptide
  XENP019420 vhCDR1
SYTMH

SEQ ID NO: 4332 - protein, 17 aa, Artificial Sequence
  Description of Artificial Sequence: Synthetic peptide
  XENP019420 vhCDR2
FISYDGNNKYYADSVKG

SEQ ID NO: 4333 - protein, 9 aa, Artificial Sequence
  Description of Artificial Sequence: Synthetic peptide
  XENP019420 vhCDR3
TGWLGPFDY

SEQ ID NO: 4334 - protein, 215 aa, Artificial Sequence
  Description of Artificial Sequence: Synthetic polypeptide
  XENP019420 [CTLA-4]_H0_L0.5_Fab Light Chain
EIRLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4335 - protein, 108 aa, Artificial Sequence; identical to SEQ ID NO: 1454
  Description of Artificial Sequence: Synthetic polypeptide
  VL of XENP019420

SEQ ID NO: 4336 - protein, 12 aa, Artificial Sequence
  Description of Artificial Sequence: Synthetic peptide
  XENP019420 vlCDR1
RASQSVGSSYLA

SEQ ID NO: 4337 - protein, 7 aa, Artificial Sequence
  Description of Artificial Sequence: Synthetic peptide
  XENP019420 vlCDR2
GAFSRAT

SEQ ID NO: 4338 - protein, 9 aa, Artificial Sequence
  Description of Artificial Sequence: Synthetic peptide
  XENP019420 vlCDR3
QQYGSSPWT

SEQ ID NO: 4339 - protein, 221 aa, Artificial Sequence; identical to SEQ ID NO: 2919
  Description of Artificial Sequence: Synthetic polypeptide
  XENP019421 [CTLA-4]_H0_L0.6_Fab Heavy Chain

SEQ ID NO: 4340 - protein, 118 aa, Artificial Sequence; identical to SEQ ID NO: 22
  Description of Artificial Sequence: Synthetic polypeptide
  VH of XENP019421

SEQ ID NO: 4341 - protein, 5 aa, Artificial Sequence
  Description of Artificial Sequence: Synthetic peptide
  XENP019421 vhCDR1
SYTMH

SEQ ID NO: 4342 - protein, 17 aa, Artificial Sequence
  Description of Artificial Sequence: Synthetic peptide
  XENP019421 vhCDR2
FISYDGNNKYYADSVKG

SEQ ID NO: 4343 - protein, 9 aa, Artificial Sequence
  Description of Artificial Sequence: Synthetic peptide
  XENP019421 vhCDR3
TGWLGPFDY

SEQ ID NO: 4344 - protein, 215 aa, Artificial Sequence
  Description of Artificial Sequence: Synthetic polypeptide
  XENP019421 [CTLA-4]_H0_L0.6_Fab Light Chain
EIRLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGEGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4345 - protein, 108 aa, Artificial Sequence; identical to SEQ ID NO: 1463
  Description of Artificial Sequence: Synthetic polypeptide
  VL of XENP019421

SEQ ID NO: 4346 - protein, 12 aa, Artificial Sequence
  Description of Artificial Sequence: Synthetic peptide
  XENP019421 vlCDR1
RASQSVGSSYLA

SEQ ID NO: 4347 - protein, 7 aa, Artificial Sequence
  Description of Artificial Sequence: Synthetic peptide
  XENP019421 vlCDR2
GAFSRAT

SEQ ID NO: 4348 - protein, 9 aa, Artificial Sequence
  Description of Artificial Sequence: Synthetic peptide
  XENP019421 vlCDR3
QQYGSSPWT

SEQ ID NO: 4349 - protein, 221 aa, Artificial Sequence; identical to SEQ ID NO: 2919
  Description of Artificial Sequence: Synthetic polypeptide
  XENP019422 [CTLA-4]_H0_L0.7_Fab Heavy Chain

SEQ ID NO: 4350 - protein, 118 aa, Artificial Sequence; identical to SEQ ID NO: 22
  Description of Artificial Sequence: Synthetic polypeptide
  VH of XENP019422

SEQ ID NO: 4351 - protein, 5 aa, Artificial Sequence
  Description of Artificial Sequence: Synthetic peptide
  XENP019422 vhCDR1
SYTMH

SEQ ID NO: 4352 - protein, 17 aa, Artificial Sequence
  Description of Artificial Sequence: Synthetic peptide
  XENP019422 vhCDR2
FISYDGNNKYYADSVKG

SEQ ID NO: 4353 - protein, 9 aa, Artificial Sequence
  Description of Artificial Sequence: Synthetic peptide
  XENP019422 vhCDR3
TGWLGPFDY

SEQ ID NO: 4354 - protein, 215 aa, Artificial Sequence
  Description of Artificial Sequence: Synthetic polypeptide
  XENP019422 [CTLA-4]_H0_L0.7_Fab Light Chain
EIVMTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4355 - protein, 108 aa, Artificial Sequence; identical to SEQ ID NO: 1472
  Description of Artificial Sequence: Synthetic polypeptide
  VL of XENP019422

SEQ ID NO: 4356 - protein, 12 aa, Artificial Sequence
  Description of Artificial Sequence: Synthetic peptide
  XENP019422 vlCDR1
RASQSVGSSYLA

SEQ ID NO: 4357 - protein, 7 aa, Artificial Sequence
  Description of Artificial Sequence: Synthetic peptide
  XENP019422 vlCDR2
GAFSRAT

SEQ ID NO: 4358 - protein, 9 aa, Artificial Sequence
  Description of Artificial Sequence: Synthetic peptide
  XENP019422 vlCDR3
QQYGSSPWT

SEQ ID NO: 4359 - protein, 221 aa, Artificial Sequence; identical to SEQ ID NO: 2919
  Description of Artificial Sequence: Synthetic polypeptide
  XENP019423 [CTLA-4]_H0_L0.8_Fab Heavy Chain

SEQ ID NO: 4360 - protein, 118 aa, Artificial Sequence; identical to SEQ ID NO: 22
  Description of Artificial Sequence: Synthetic polypeptide
  VH of XENP019423

SEQ ID NO: 4361 - protein, 5 aa, Artificial Sequence
  Description of Artificial Sequence: Synthetic peptide
  XENP019423 vhCDR1
SYTMH

SEQ ID NO: 4362 - protein, 17 aa, Artificial Sequence
  Description of Artificial Sequence: Synthetic peptide
  XENP019423 vhCDR2
FISYDGNNKYYADSVKG

SEQ ID NO: 4363 - protein, 9 aa, Artificial Sequence
  Description of Artificial Sequence: Synthetic peptide
  XENP019423 vhCDR3
TGWLGPFDY

SEQ ID NO: 4364 - protein, 215 aa, Artificial Sequence
  Description of Artificial Sequence: Synthetic polypeptide
  XENP019423 [CTLA-4]_H0_L0.8_Fab Light Chain
EIVLTQSPATLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4365 - protein, 108 aa, Artificial Sequence; identical to SEQ ID NO: 1481
  Description of Artificial Sequence: Synthetic polypeptide
  VL of XENP019423

SEQ ID NO: 4366 - protein, 12 aa, Artificial Sequence
  Description of Artificial Sequence: Synthetic peptide
  XENP019423 vlCDR1
RASQSVGSSYLA

SEQ ID NO: 4367 - protein, 7 aa, Artificial Sequence
  Description of Artificial Sequence: Synthetic peptide
  XENP019423 vlCDR2
GAFSRAT

SEQ ID NO: 4368 - protein, 9 aa, Artificial Sequence
  Description of Artificial Sequence: Synthetic peptide
  XENP019423 vlCDR3
QQYGSSPWT

SEQ ID NO: 4369 - protein, 221 aa, Artificial Sequence; identical to SEQ ID NO: 2919
  Description of Artificial Sequence: Synthetic polypeptide
  XENP019424 [CTLA-4]_H0_L0.9_Fab Heavy Chain

SEQ ID NO: 4370 - protein, 118 aa, Artificial Sequence; identical to SEQ ID NO: 22
  Description of Artificial Sequence: Synthetic polypeptide
  VH of XENP019424

SEQ ID NO: 4371 - protein, 5 aa, Artificial Sequence
  Description of Artificial Sequence: Synthetic peptide
  XENP019424 vhCDR1
SYTMH

SEQ ID NO: 4372 - protein, 17 aa, Artificial Sequence
  Description of Artificial Sequence: Synthetic peptide
  XENP019424 vhCDR2
FISYDGNNKYYADSVKG

SEQ ID NO: 4373 - protein, 9 aa, Artificial Sequence
  Description of Artificial Sequence: Synthetic peptide
  XENP019424 vhCDR3
TGWLGPFDY

SEQ ID NO: 4374 - protein, 215 aa, Artificial Sequence
  Description of Artificial Sequence: Synthetic polypeptide
  XENP019424 [CTLA-4]_H0_L0.9_Fab Light Chain
EIVLTQSPPTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4375 - protein, 108 aa, Artificial Sequence; identical to SEQ ID NO: 1490
  Description of Artificial Sequence: Synthetic polypeptide
  VL of XENP019424

SEQ ID NO: 4376 - protein, 12 aa, Artificial Sequence
  Description of Artificial Sequence: Synthetic peptide
  XENP019424 vlCDR1
RASQSVGSSYLA

SEQ ID NO: 4377 - protein, 7 aa, Artificial Sequence
  Description of Artificial Sequence: Synthetic peptide
  XENP019424 vlCDR2
GAFSRAT

SEQ ID NO: 4378 - protein, 9 aa, Artificial Sequence
  Description of Artificial Sequence: Synthetic peptide
  XENP019424 vlCDR3
QQYGSSPWT

SEQ ID NO: 4379 - protein, 221 aa, Artificial Sequence; identical to SEQ ID NO: 2919
  Description of Artificial Sequence: Synthetic polypeptide
  XENP019425 [CTLA-4]_H0_L0.10_Fab Heavy Chain

SEQ ID NO: 4380 - protein, 118 aa, Artificial Sequence; identical to SEQ ID NO: 22
  Description of Artificial Sequence: Synthetic polypeptide
  VH of XENP019425

SEQ ID NO: 4381 - protein, 5 aa, Artificial Sequence
  Description of Artificial Sequence: Synthetic peptide
  XENP019425 vhCDR1
SYTMH

SEQ ID NO: 4382 - protein, 17 aa, Artificial Sequence
  Description of Artificial Sequence: Synthetic peptide
  XENP019425 vhCDR2
FISYDGNNKYYADSVKG

SEQ ID NO: 4383 - protein, 9 aa, Artificial Sequence
  Description of Artificial Sequence: Synthetic peptide
  XENP019425 vhCDR3
TGWLGPFDY

SEQ ID NO: 4384 - protein, 215 aa, Artificial Sequence
  Description of Artificial Sequence: Synthetic polypeptide
  XENP019425 [CTLA-4]_H0_L0.10_Fab Light Chain
EIVLTQSPSTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4385 - protein, 108 aa, Artificial Sequence; identical to SEQ ID NO: 1499
  Description of Artificial Sequence: Synthetic polypeptide
  VL of XENP019425

SEQ ID NO: 4386 - protein, 12 aa, Artificial Sequence
  Description of Artificial Sequence: Synthetic peptide
  XENP019425 vlCDR1
RASQSVGSSYLA

SEQ ID NO: 4387 - protein, 7 aa, Artificial Sequence
  Description of Artificial Sequence: Synthetic peptide
  XENP019425 vlCDR2
GAFSRAT

SEQ ID NO: 4388 - protein, 9 aa, Artificial Sequence
  Description of Artificial Sequence: Synthetic peptide
  XENP019425 vlCDR3
QQYGSSPWT

SEQ ID NO: 4389 - protein, 221 aa, Artificial Sequence; identical to SEQ ID NO: 2919
  Description of Artificial Sequence: Synthetic polypeptide
  XENP019426 [CTLA-4]_H0_L0.11_Fab Heavy Chain

SEQ ID NO: 4390 - protein, 118 aa, Artificial Sequence; identical to SEQ ID NO: 22
  Description of Artificial Sequence: Synthetic polypeptide
  VH of XENP019426

SEQ ID NO: 4391 - protein, 5 aa, Artificial Sequence
  Description of Artificial Sequence: Synthetic peptide
  XENP019426 vhCDR1
SYTMH

SEQ ID NO: 4392 - protein, 17 aa, Artificial Sequence
  Description of Artificial Sequence: Synthetic peptide
  XENP019426 vhCDR2
FISYDGNNKYYADSVKG

SEQ ID NO: 4393 - protein, 9 aa, Artificial Sequence
  Description of Artificial Sequence: Synthetic peptide
  XENP019426 vhCDR3
TGWLGPFDY

SEQ ID NO: 4394 - protein, 215 aa, Artificial Sequence
  Description of Artificial Sequence: Synthetic polypeptide
  XENP019426 [CTLA-4]_H0_L0.11_Fab Light Chain
EIVLTQSPGSLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4395 - protein, 108 aa, Artificial Sequence; identical to SEQ ID NO: 1508
  Description of Artificial Sequence: Synthetic polypeptide
  VL of XENP019426

SEQ ID NO: 4396 - protein, 12 aa, Artificial Sequence
  Description of Artificial Sequence: Synthetic peptide
  XENP019426 vlCDR1
RASQSVGSSYLA

SEQ ID NO: 4397 - protein, 7 aa, Artificial Sequence
  Description of Artificial Sequence: Synthetic peptide
  XENP019426 vlCDR2
GAFSRAT

SEQ ID NO: 4398 - protein, 9 aa, Artificial Sequence
  Description of Artificial Sequence: Synthetic peptide
  XENP019426 vlCDR3
QQYGSSPWT

SEQ ID NO: 4399 - protein, 221 aa, Artificial Sequence; identical to SEQ ID NO: 2919
  Description of Artificial Sequence: Synthetic polypeptide
  XENP019427 [CTLA-4]_H0_L0.12_Fab Heavy Chain

SEQ ID NO: 4400 - protein, 118 aa, Artificial Sequence; identical to SEQ ID NO: 22
  Description of Artificial Sequence: Synthetic polypeptide
  VH of XENP019427

SEQ ID NO: 4401 - protein, 5 aa, Artificial Sequence
  Description of Artificial Sequence: Synthetic peptide
  XENP019427 vhCDR1
SYTMH

SEQ ID NO: 4402 - protein, 17 aa, Artificial Sequence
  Description of Artificial Sequence: Synthetic peptide
  XENP019427 vhCDR2
FISYDGNNKYYADSVKG

SEQ ID NO: 4403 - protein, 9 aa, Artificial Sequence
  Description of Artificial Sequence: Synthetic peptide
  XENP019427 vhCDR3
TGWLGPFDY

SEQ ID NO: 4404 - protein, 215 aa, Artificial Sequence
  Description of Artificial Sequence: Synthetic polypeptide
  XENP019427 [CTLA-4]_H0_L0.12_Fab Light Chain
EIVLTQSPGTLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4405 - protein, 108 aa, Artificial Sequence; identical to SEQ ID NO: 1517
  Description of Artificial Sequence: Synthetic polypeptide
  VL of XENP019427

SEQ ID NO: 4406 - protein, 12 aa, Artificial Sequence
  Description of Artificial Sequence: Synthetic peptide
  XENP019427 vlCDR1
RASQSVGSSYLA

SEQ ID NO: 4407 - protein, 7 aa, Artificial Sequence
  Description of Artificial Sequence: Synthetic peptide
  XENP019427 vlCDR2
GAFSRAT

SEQ ID NO: 4408 - protein, 9 aa, Artificial Sequence
  Description of Artificial Sequence: Synthetic peptide
  XENP019427 vlCDR3
QQYGSSPWT

SEQ ID NO: 4409 - protein, 221 aa, Artificial Sequence; identical to SEQ ID NO: 2919
  Description of Artificial Sequence: Synthetic polypeptide
  XENP019428 [CTLA-4]_H0_L0.13_Fab Heavy Chain

SEQ ID NO: 4410 - protein, 118 aa, Artificial Sequence; identical to SEQ ID NO: 22
  Description of Artificial Sequence: Synthetic polypeptide
  VH of XENP019428

SEQ ID NO: 4411 - protein, 5 aa, Artificial Sequence
  Description of Artificial Sequence: Synthetic peptide
  XENP019428 vhCDR1
SYTMH

SEQ ID NO: 4412 - protein, 17 aa, Artificial Sequence
  Description of Artificial Sequence: Synthetic peptide
  XENP019428 vhCDR2
FISYDGNNKYYADSVKG

SEQ ID NO: 4413 - protein, 9 aa, Artificial Sequence
  Description of Artificial Sequence: Synthetic peptide
  XENP019428 vhCDR3
TGWLGPFDY

SEQ ID NO: 4414 - protein, 215 aa, Artificial Sequence
  Description of Artificial Sequence: Synthetic polypeptide
  XENP019428 [CTLA-4]_H0_L0.13_Fab Light Chain
EIVLTQSPGTLSLSPGEPATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4415 - protein, 108 aa, Artificial Sequence; identical to SEQ ID NO: 1526
  Description of Artificial Sequence: Synthetic polypeptide
  VL of XENP019428

SEQ ID NO: 4416 - protein, 12 aa, Artificial Sequence
  Description of Artificial Sequence: Synthetic peptide
  XENP019428 vlCDR1
RASQSVGSSYLA

SEQ ID NO: 4417 - protein, 7 aa, Artificial Sequence
  Description of Artificial Sequence: Synthetic peptide
  XENP019428 vlCDR2
GAFSRAT

SEQ ID NO: 4418 - protein, 9 aa, Artificial Sequence
  Description of Artificial Sequence: Synthetic peptide
  XENP019428 vlCDR3
QQYGSSPWT

SEQ ID NO: 4419 - protein, 221 aa, Artificial Sequence; identical to SEQ ID NO: 2919
  Description of Artificial Sequence: Synthetic polypeptide
  XENP019429 [CTLA-4]_H0_L0.14_Fab Heavy Chain

SEQ ID NO: 4420 - protein, 118 aa, Artificial Sequence; identical to SEQ ID NO: 22
  Description of Artificial Sequence: Synthetic polypeptide
  VH of XENP019429

SEQ ID NO: 4421 - protein, 5 aa, Artificial Sequence
  Description of Artificial Sequence: Synthetic peptide
  XENP019429 vhCDR1
SYTMH

SEQ ID NO: 4422 - protein, 17 aa, Artificial Sequence
  Description of Artificial Sequence: Synthetic peptide
  XENP019429 vhCDR2
FISYDGNNKYYADSVKG

SEQ ID NO: 4423 - protein, 9 aa, Artificial Sequence
  Description of Artificial Sequence: Synthetic peptide
  XENP019429 vhCDR3
TGWLGPFDY

SEQ ID NO: 4424 - protein, 215 aa, Artificial Sequence
  Description of Artificial Sequence: Synthetic polypeptide
  XENP019429 [CTLA-4]_H0_L0.14_Fab Light Chain
EIVLTQSPGTLSLSPGEQATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4425 - protein, 108 aa, Artificial Sequence; identical to SEQ ID NO: 1535
  Description of Artificial Sequence: Synthetic polypeptide
  VL of XENP019429

SEQ ID NO: 4426 - protein, 12 aa, Artificial Sequence
  Description of Artificial Sequence: Synthetic peptide
  XENP019429 vlCDR1
RASQSVGSSYLA

SEQ ID NO: 4427 - protein, 7 aa, Artificial Sequence
  Description of Artificial Sequence: Synthetic peptide
  XENP019429 vlCDR2
GAFSRAT

SEQ ID NO: 4428 - protein, 9 aa, Artificial Sequence
  Description of Artificial Sequence: Synthetic peptide
  XENP019429 vlCDR3
QQYGSSPWT

SEQ ID NO: 4429 - protein, 221 aa, Artificial Sequence; identical to SEQ ID NO: 2919
  Description of Artificial Sequence: Synthetic polypeptide
  XENP019430 [CTLA-4]_H0_L0.15_Fab Heavy Chain

SEQ ID NO: 4430 - protein, 118 aa, Artificial Sequence; identical to SEQ ID NO: 22
  Description of Artificial Sequence: Synthetic polypeptide
  VH of XENP019430

SEQ ID NO: 4431 - protein, 5 aa, Artificial Sequence
  Description of Artificial Sequence: Synthetic peptide
  XENP019430 vhCDR1
SYTMH

SEQ ID NO: 4432 - protein, 17 aa, Artificial Sequence
  Description of Artificial Sequence: Synthetic peptide
  XENP019430 vhCDR2
FISYDGNNKYYADSVKG

SEQ ID NO: 4433 - protein, 9 aa, Artificial Sequence
  Description of Artificial Sequence: Synthetic peptide
  XENP019430 vhCDR3
TGWLGPFDY

SEQ ID NO: 4434 - protein, 215 aa, Artificial Sequence
  Description of Artificial Sequence: Synthetic polypeptide
  XENP019430 [CTLA-4]_H0_L0.15_Fab Light Chain
EIVLTQSPGTLSLSPGERVTLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4435 - protein, 108 aa, Artificial Sequence; identical to SEQ ID NO: 1544
  Description of Artificial Sequence: Synthetic polypeptide
  VL of XENP019430

SEQ ID NO: 4436 - protein, 12 aa, Artificial Sequence
  Description of Artificial Sequence: Synthetic peptide
  XENP019430 vlCDR1
RASQSVGSSYLA

SEQ ID NO: 4437 - protein, 7 aa, Artificial Sequence
  Description of Artificial Sequence: Synthetic peptide
  XENP019430 vlCDR2
GAFSRAT

SEQ ID NO: 4438 - protein, 9 aa, Artificial Sequence
  Description of Artificial Sequence: Synthetic peptide
  XENP019430 vlCDR3
QQYGSSPWT

SEQ ID NO: 4439 - protein, 221 aa, Artificial Sequence; identical to SEQ ID NO: 2919
  Description of Artificial Sequence: Synthetic polypeptide
  XENP019431 [CTLA-4]_H0_L0.16_Fab Heavy Chain

SEQ ID NO: 4440 - protein, 118 aa, Artificial Sequence; identical to SEQ ID NO: 22
  Description of Artificial Sequence: Synthetic polypeptide
  VH of XENP019431

SEQ ID NO: 4441 - protein, 5 aa, Artificial Sequence
  Description of Artificial Sequence: Synthetic peptide
  XENP019431 vhCDR1
SYTMH

SEQ ID NO: 4442 - protein, 17 aa, Artificial Sequence
  Description of Artificial Sequence: Synthetic peptide
  XENP019431 vhCDR2
FISYDGNNKYYADSVKG

SEQ ID NO: 4443 - protein, 9 aa, Artificial Sequence
  Description of Artificial Sequence: Synthetic peptide
  XENP019431 vhCDR3
TGWLGPFDY

SEQ ID NO: 4444 - protein, 215 aa, Artificial Sequence
  Description of Artificial Sequence: Synthetic polypeptide
  XENP019431 [CTLA-4]_H0_L0.16_Fab Light Chain
EIVLTQSPGTLSLSPGERASLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4445 - protein, 108 aa, Artificial Sequence; identical to SEQ ID NO: 1553
  Description of Artificial Sequence: Synthetic polypeptide
  VL of XENP019431

SEQ ID NO: 4446 - protein, 12 aa, Artificial Sequence
  Description of Artificial Sequence: Synthetic peptide
  XENP019431 vlCDR1
RASQSVGSSYLA

SEQ ID NO: 4447 - protein, 7 aa, Artificial Sequence
  Description of Artificial Sequence: Synthetic peptide
  XENP019431 vlCDR2
GAFSRAT

SEQ ID NO: 4448 - protein, 9 aa, Artificial Sequence
  Description of Artificial Sequence: Synthetic peptide
  XENP019431 vlCDR3
QQYGSSPWT

SEQ ID NO: 4449 - protein, 221 aa, Artificial Sequence; identical to SEQ ID NO: 2919
  Description of Artificial Sequence: Synthetic polypeptide
  XENP019432 [CTLA-4]_H0_L0.17_Fab Heavy Chain

SEQ ID NO: 4450 - protein, 118 aa, Artificial Sequence; identical to SEQ ID NO: 22
  Description of Artificial Sequence: Synthetic polypeptide
  VH of XENP019432

SEQ ID NO: 4451 - protein, 5 aa, Artificial Sequence
  Description of Artificial Sequence: Synthetic peptide
  XENP019432 vhCDR1
SYTMH

SEQ ID NO: 4452 - protein, 17 aa, Artificial Sequence
  Description of Artificial Sequence: Synthetic peptide
  XENP019432 vhCDR2
FISYDGNNKYYADSVKG

SEQ ID NO: 4453 - protein, 9 aa, Artificial Sequence
  Description of Artificial Sequence: Synthetic peptide
  XENP019432 vhCDR3
TGWLGPFDY

SEQ ID NO: 4454 - protein, 215 aa, Artificial Sequence
  Description of Artificial Sequence: Synthetic polypeptide
  XENP019432 [CTLA-4]_H0_L0.17_Fab Light Chain
EIVLTQSPGTLSLSPGERATISCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4455 - protein, 108 aa, Artificial Sequence; identical to SEQ ID NO: 1562
  Description of Artificial Sequence: Synthetic polypeptide
  VL of XENP019432

SEQ ID NO: 4456 - protein, 12 aa, Artificial Sequence
  Description of Artificial Sequence: Synthetic peptide
  XENP019432 vlCDR1
RASQSVGSSYLA

SEQ ID NO: 4457 - protein, 7 aa, Artificial Sequence
  Description of Artificial Sequence: Synthetic peptide
  XENP019432 vlCDR2
GAFSRAT

SEQ ID NO: 4458 - protein, 9 aa, Artificial Sequence
  Description of Artificial Sequence: Synthetic peptide
  XENP019432 vlCDR3
QQYGSSPWT

SEQ ID NO: 4459 - protein, 221 aa, Artificial Sequence; identical to SEQ ID NO: 2919
  Description of Artificial Sequence: Synthetic polypeptide
  XENP019433 [CTLA-4]_H0_L0.18_Fab Heavy Chain

SEQ ID NO: 4460 - protein, 118 aa, Artificial Sequence; identical to SEQ ID NO: 22
  Description of Artificial Sequence: Synthetic polypeptide
  VH of XENP019433

SEQ ID NO: 4461 - protein, 5 aa, Artificial Sequence
  Description of Artificial Sequence: Synthetic peptide
  XENP019433 vhCDR1
SYTMH

SEQ ID NO: 4462 - protein, 17 aa, Artificial Sequence
  Description of Artificial Sequence: Synthetic peptide
  XENP019433 vhCDR2
FISYDGNNKYYADSVKG

SEQ ID NO: 4463 - protein, 9 aa, Artificial Sequence
  Description of Artificial Sequence: Synthetic peptide
  XENP019433 vhCDR3
TGWLGPFDY

SEQ ID NO: 4464 - protein, 215 aa, Artificial Sequence
  Description of Artificial Sequence: Synthetic polypeptide
  XENP019433 [CTLA-4]_H0_L0.18_Fab Light Chain
EIVLTQSPGTLSLSPGERATLSCRSSQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4465 - protein, 108 aa, Artificial Sequence; identical to SEQ ID NO: 1571
  Description of Artificial Sequence: Synthetic polypeptide
  VL of XENP019433

SEQ ID NO: 4466 - protein, 12 aa, Artificial Sequence
  Description of Artificial Sequence: Synthetic peptide
  XENP019433 vlCDR1
RSSQSVGSSYLA

SEQ ID NO: 4467 - protein, 7 aa, Artificial Sequence
  Description of Artificial Sequence: Synthetic peptide
  XENP019433 vlCDR2
GAFSRAT

SEQ ID NO: 4468 - protein, 9 aa, Artificial Sequence
  Description of Artificial Sequence: Synthetic peptide
  XENP019433 vlCDR3
QQYGSSPWT

SEQ ID NO: 4469 - protein, 221 aa, Artificial Sequence; identical to SEQ ID NO: 2919
  Description of Artificial Sequence: Synthetic polypeptide
  XENP019434 [CTLA-4]_H0_L0.19_Fab Heavy Chain

SEQ ID NO: 4470 - protein, 118 aa, Artificial Sequence; identical to SEQ ID NO: 22
  Description of Artificial Sequence: Synthetic polypeptide
  VH of XENP019434

SEQ ID NO: 4471 - protein, 5 aa, Artificial Sequence
  Description of Artificial Sequence: Synthetic peptide
  XENP019434 vhCDR1
SYTMH

SEQ ID NO: 4472 - protein, 17 aa, Artificial Sequence
  Description of Artificial Sequence: Synthetic peptide
  XENP019434 vhCDR2
FISYDGNNKYYADSVKG

SEQ ID NO: 4473 - protein, 9 aa, Artificial Sequence
  Description of Artificial Sequence: Synthetic peptide
  XENP019434 vhCDR3
TGWLGPFDY

SEQ ID NO: 4474 - protein, 215 aa, Artificial Sequence
  Description of Artificial Sequence: Synthetic polypeptide
  XENP019434 [CTLA-4]_H0_L0.19_Fab Light Chain
EIVLTQSPGTLSLSPGERATLSCRASQSDGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4475 - protein, 108 aa, Artificial Sequence; identical to SEQ ID NO: 1580
  Description of Artificial Sequence: Synthetic polypeptide
  VL of XENP019434

SEQ ID NO: 4476 - protein, 12 aa, Artificial Sequence
  Description of Artificial Sequence: Synthetic peptide
  XENP019434 vlCDR1
RASQSDGSSYLA

SEQ ID NO: 4477 - protein, 7 aa, Artificial Sequence
  Description of Artificial Sequence: Synthetic peptide
  XENP019434 vlCDR2
GAFSRAT

SEQ ID NO: 4478 - protein, 9 aa, Artificial Sequence
  Description of Artificial Sequence: Synthetic peptide
  XENP019434 vlCDR3
QQYGSSPWT

SEQ ID NO: 4479 - protein, 221 aa, Artificial Sequence; identical to SEQ ID NO: 2919
  Description of Artificial Sequence: Synthetic polypeptide
  XENP019435 [CTLA-4]_H0_L0.20_Fab Heavy Chain

SEQ ID NO: 4480 - protein, 118 aa, Artificial Sequence; identical to SEQ ID NO: 22
  Description of Artificial Sequence: Synthetic polypeptide
  VH of XENP019435

SEQ ID NO: 4481 - protein, 5 aa, Artificial Sequence
  Description of Artificial Sequence: Synthetic peptide
  XENP019435 vhCDR1
SYTMH

SEQ ID NO: 4482 - protein, 17 aa, Artificial Sequence
  Description of Artificial Sequence: Synthetic peptide
  XENP019435 vhCDR2
FISYDGNNKYYADSVKG

SEQ ID NO: 4483 - protein, 9 aa, Artificial Sequence
  Description of Artificial Sequence: Synthetic peptide
  XENP019435 vhCDR3
TGWLGPFDY

SEQ ID NO: 4484 - protein, 215 aa, Artificial Sequence
  Description of Artificial Sequence: Synthetic polypeptide
  XENP019435 [CTLA-4]_H0_L0.20_Fab Light Chain
EIVLTQSPGTLSLSPGERATLSCRASQSSGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4485 - protein, 108 aa, Artificial Sequence; identical to SEQ ID NO: 1589
  Description of Artificial Sequence: Synthetic polypeptide
  VL of XENP019435

SEQ ID NO: 4486 - protein, 12 aa, Artificial Sequence
  Description of Artificial Sequence: Synthetic peptide
  XENP019435 vlCDR1
RASQSSGSSYLA

SEQ ID NO: 4487 - protein, 7 aa, Artificial Sequence
  Description of Artificial Sequence: Synthetic peptide
  XENP019435 vlCDR2
GAFSRAT

SEQ ID NO: 4488 - protein, 9 aa, Artificial Sequence
  Description of Artificial Sequence: Synthetic peptide
  XENP019435 vlCDR3
QQYGSSPWT

SEQ ID NO: 4489 - protein, 221 aa, Artificial Sequence; identical to SEQ ID NO: 2919
  Description of Artificial Sequence: Synthetic polypeptide
  XENP019436 [CTLA-4]_H0_L0.21_Fab Heavy Chain

SEQ ID NO: 4490 - protein, 118 aa, Artificial Sequence; identical to SEQ ID NO: 22
  Description of Artificial Sequence: Synthetic polypeptide
  VH of XENP019436

SEQ ID NO: 4491 - protein, 5 aa, Artificial Sequence
  Description of Artificial Sequence: Synthetic peptide
  XENP019436 vhCDR1
SYTMH

SEQ ID NO: 4492 - protein, 17 aa, Artificial Sequence
  Description of Artificial Sequence: Synthetic peptide
  XENP019436 vhCDR2
FISYDGNNKYYADSVKG

SEQ ID NO: 4493 - protein, 9 aa, Artificial Sequence
  Description of Artificial Sequence: Synthetic peptide
  XENP019436 vhCDR3
TGWLGPFDY

SEQ ID NO: 4494 - protein, 215 aa, Artificial Sequence
  Description of Artificial Sequence: Synthetic polypeptide
  XENP019436 [CTLA-4]_H0_L0.21_Fab Light Chain
EIVLTQSPGTLSLSPGERATLSCRASQSVASSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4495 - protein, 108 aa, Artificial Sequence; identical to SEQ ID NO: 1598
  Description of Artificial Sequence: Synthetic polypeptide
  VL of XENP019436

SEQ ID NO: 4496 - protein, 12 aa, Artificial Sequence
  Description of Artificial Sequence: Synthetic peptide
  XENP019436 vlCDR1
RASQSVASSYLA

SEQ ID NO: 4497 - protein, 7 aa, Artificial Sequence
  Description of Artificial Sequence: Synthetic peptide
  XENP019436 vlCDR2
GAFSRAT

SEQ ID NO: 4498 - protein, 9 aa, Artificial Sequence
  Description of Artificial Sequence: Synthetic peptide
  XENP019436 vlCDR3
QQYGSSPWT

SEQ ID NO: 4499 - protein, 221 aa, Artificial Sequence; identical to SEQ ID NO: 2919
  Description of Artificial Sequence: Synthetic polypeptide
  XENP019437 [CTLA-4]_H0_L0.22_Fab Heavy Chain

SEQ ID NO: 4500 - protein, 118 aa, Artificial Sequence; identical to SEQ ID NO: 22
  Description of Artificial Sequence: Synthetic polypeptide
  VH of XENP019437

SEQ ID NO: 4501 - protein, 5 aa, Artificial Sequence
  Description of Artificial Sequence: Synthetic peptide
  XENP019437 vhCDR1
SYTMH

SEQ ID NO: 4502 - protein, 17 aa, Artificial Sequence
  Description of Artificial Sequence: Synthetic peptide
  XENP019437 vhCDR2
FISYDGNNKYYADSVKG

SEQ ID NO: 4503 - protein, 9 aa, Artificial Sequence
  Description of Artificial Sequence: Synthetic peptide
  XENP019437 vhCDR3
TGWLGPFDY

SEQ ID NO: 4504 - protein, 215 aa, Artificial Sequence
  Description of Artificial Sequence: Synthetic polypeptide
  XENP019437 [CTLA-4]_H0_L0.22_Fab Light Chain
EIVLTQSPGTLSLSPGERATLSCRASQSVSSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4505 - protein, 108 aa, Artificial Sequence; identical to SEQ ID NO: 1607
  Description of Artificial Sequence: Synthetic polypeptide
  VL of XENP019437

SEQ ID NO: 4506 - protein, 12 aa, Artificial Sequence
  Description of Artificial Sequence: Synthetic peptide
  XENP019437 vlCDR1
RASQSVSSSYLA

SEQ ID NO: 4507 - protein, 7 aa, Artificial Sequence
  Description of Artificial Sequence: Synthetic peptide
  XENP019437 vlCDR2
GAFSRAT

SEQ ID NO: 4508 - protein, 9 aa, Artificial Sequence
  Description of Artificial Sequence: Synthetic peptide
  XENP019437 vlCDR3
QQYGSSPWT

SEQ ID NO: 4509 - protein, 221 aa, Artificial Sequence; identical to SEQ ID NO: 2919
  Description of Artificial Sequence: Synthetic polypeptide
  XENP019438 [CTLA-4]_H0_L0.23_Fab Heavy Chain

SEQ ID NO: 4510 - protein, 118 aa, Artificial Sequence; identical to SEQ ID NO: 22
  Description of Artificial Sequence: Synthetic polypeptide
  VH of XENP019438

SEQ ID NO: 4511 - protein, 5 aa, Artificial Sequence
  Description of Artificial Sequence: Synthetic peptide
  XENP019438 vhCDR1
SYTMH

SEQ ID NO: 4512 - protein, 17 aa, Artificial Sequence
  Description of Artificial Sequence: Synthetic peptide
  XENP019438 vhCDR2
FISYDGNNKYYADSVKG

SEQ ID NO: 4513 - protein, 9 aa, Artificial Sequence
  Description of Artificial Sequence: Synthetic peptide
  XENP019438 vhCDR3
TGWLGPFDY

SEQ ID NO: 4514 - protein, 215 aa, Artificial Sequence
  Description of Artificial Sequence: Synthetic polypeptide
  XENP019438 [CTLA-4]_H0_L0.23_Fab Light Chain
EIVLTQSPGTLSLSPGERATLSCRASQSVTSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4515 - protein, 108 aa, Artificial Sequence; identical to SEQ ID NO: 1616
  Description of Artificial Sequence: Synthetic polypeptide
  VL of XENP019438

SEQ ID NO: 4516 - protein, 12 aa, Artificial Sequence
  Description of Artificial Sequence: Synthetic peptide
  XENP019438 vlCDR1
RASQSVTSSYLA

SEQ ID NO: 4517 - protein, 7 aa, Artificial Sequence
  Description of Artificial Sequence: Synthetic peptide
  XENP019438 vlCDR2
GAFSRAT

SEQ ID NO: 4518 - protein, 9 aa, Artificial Sequence
  Description of Artificial Sequence: Synthetic peptide
  XENP019438 vlCDR3
QQYGSSPWT

SEQ ID NO: 4519 - protein, 221 aa, Artificial Sequence; identical to SEQ ID NO: 2919
  Description of Artificial Sequence: Synthetic polypeptide
  XENP019439 [CTLA-4]_H0_L0.24_Fab Heavy Chain

SEQ ID NO: 4520 - protein, 118 aa, Artificial Sequence; identical to SEQ ID NO: 22
  Description of Artificial Sequence: Synthetic polypeptide
  VH of XENP019439

SEQ ID NO: 4521 - protein, 5 aa, Artificial Sequence
  Description of Artificial Sequence: Synthetic peptide
  XENP019439 vhCDR1
SYTMH

SEQ ID NO: 4522 - protein, 17 aa, Artificial Sequence
  Description of Artificial Sequence: Synthetic peptide
  XENP019439 vhCDR2
FISYDGNNKYYADSVKG

SEQ ID NO: 4523 - protein, 9 aa, Artificial Sequence
  Description of Artificial Sequence: Synthetic peptide
  XENP019439 vhCDR3
TGWLGPFDY

SEQ ID NO: 4524 - protein, 215 aa, Artificial Sequence
  Description of Artificial Sequence: Synthetic polypeptide
  XENP019439 [CTLA-4]_H0_L0.24_Fab Light Chain
EIVLTQSPGTLSLSPGERATLSCRASQSVGASYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4525 - protein, 108 aa, Artificial Sequence; identical to SEQ ID NO: 1625
  Description of Artificial Sequence: Synthetic polypeptide
  VL of XENP019439

SEQ ID NO: 4526 - protein, 12 aa, Artificial Sequence
  Description of Artificial Sequence: Synthetic peptide
  XENP019439 vlCDR1
RASQSVGASYLA

SEQ ID NO: 4527 - protein, 7 aa, Artificial Sequence
  Description of Artificial Sequence: Synthetic peptide
  XENP019439 vlCDR2
GAFSRAT

SEQ ID NO: 4528 - protein, 9 aa, Artificial Sequence
  Description of Artificial Sequence: Synthetic peptide
  XENP019439 vlCDR3
QQYGSSPWT

SEQ ID NO: 4529 - protein, 221 aa, Artificial Sequence; identical to SEQ ID NO: 2919
  Description of Artificial Sequence: Synthetic polypeptide
  XENP019440 [CTLA-4]_H0_L0.25_Fab Heavy Chain

SEQ ID NO: 4530 - protein, 118 aa, Artificial Sequence; identical to SEQ ID NO: 22
  Description of Artificial Sequence: Synthetic polypeptide
  VH of XENP019440

SEQ ID NO: 4531 - protein, 5 aa, Artificial Sequence
  Description of Artificial Sequence: Synthetic peptide
  XENP019440 vhCDR1
SYTMH

SEQ ID NO: 4532 - protein, 17 aa, Artificial Sequence
  Description of Artificial Sequence: Synthetic peptide
  XENP019440 vhCDR2
FISYDGNNKYYADSVKG

SEQ ID NO: 4533 - protein, 9 aa, Artificial Sequence
  Description of Artificial Sequence: Synthetic peptide
  XENP019440 vhCDR3
TGWLGPFDY

SEQ ID NO: 4534 - protein, 215 aa, Artificial Sequence
  Description of Artificial Sequence: Synthetic polypeptide
  XENP019440 [CTLA-4]_H0_L0.25_Fab Light Chain
EIVLTQSPGTLSLSPGERATLSCRASQSVGGSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4535 - protein, 108 aa, Artificial Sequence; identical to SEQ ID NO: 1634
  Description of Artificial Sequence: Synthetic polypeptide
  VL of XENP019440

SEQ ID NO: 4536 - protein, 12 aa, Artificial Sequence
  Description of Artificial Sequence: Synthetic peptide
  XENP019440 vlCDR1
RASQSVGGSYLA

SEQ ID NO: 4537 - protein, 7 aa, Artificial Sequence
  Description of Artificial Sequence: Synthetic peptide
  XENP019440 vlCDR2
GAFSRAT

SEQ ID NO: 4538 - protein, 9 aa, Artificial Sequence
  Description of Artificial Sequence: Synthetic peptide
  XENP019440 vlCDR3
QQYGSSPWT

SEQ ID NO: 4539 - protein, 221 aa, Artificial Sequence; identical to SEQ ID NO: 2919
  Description of Artificial Sequence: Synthetic polypeptide
  XENP019441 [CTLA-4]_H0_L0.26_Fab Heavy Chain

SEQ ID NO: 4540 - protein, 118 aa, Artificial Sequence; identical to SEQ ID NO: 22
  Description of Artificial Sequence: Synthetic polypeptide
  VH of XENP019441

SEQ ID NO: 4541 - protein, 5 aa, Artificial Sequence
  Description of Artificial Sequence: Synthetic peptide
  XENP019441 vhCDR1
SYTMH

SEQ ID NO: 4542 - protein, 17 aa, Artificial Sequence
  Description of Artificial Sequence: Synthetic peptide
  XENP019441 vhCDR2
FISYDGNNKYYADSVKG

SEQ ID NO: 4543 - protein, 9 aa, Artificial Sequence
  Description of Artificial Sequence: Synthetic peptide
  XENP019441 vhCDR3
TGWLGPFDY

SEQ ID NO: 4544 - protein, 215 aa, Artificial Sequence
  Description of Artificial Sequence: Synthetic polypeptide
  XENP019441 [CTLA-4]_H0_L0.26_Fab Light Chain
EIVLTQSPGTLSLSPGERATLSCRASQSVGNSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4545 - protein, 108 aa, Artificial Sequence; identical to SEQ ID NO: 1643
  Description of Artificial Sequence: Synthetic polypeptide
  VL of XENP019441

SEQ ID NO: 4546 - protein, 12 aa, Artificial Sequence
  Description of Artificial Sequence: Synthetic peptide
  XENP019441 vlCDR1
RASQSVGNSYLA

SEQ ID NO: 4547 - protein, 7 aa, Artificial Sequence
  Description of Artificial Sequence: Synthetic peptide
  XENP019441 vlCDR2
GAFSRAT

SEQ ID NO: 4548 - protein, 9 aa, Artificial Sequence
  Description of Artificial Sequence: Synthetic peptide
  XENP019441 vlCDR3
QQYGSSPWT

SEQ ID NO: 4549 - protein, 221 aa, Artificial Sequence; identical to SEQ ID NO: 2919
  Description of Artificial Sequence: Synthetic polypeptide
  XENP019442 [CTLA-4]_H0_L0.27_Fab Heavy Chain

SEQ ID NO: 4550 - protein, 118 aa, Artificial Sequence; identical to SEQ ID NO: 22
  Description of Artificial Sequence: Synthetic polypeptide
  VH of XENP019442

SEQ ID NO: 4551 - protein, 5 aa, Artificial Sequence
  Description of Artificial Sequence: Synthetic peptide
  XENP019442 vhCDR1
SYTMH

SEQ ID NO: 4552 - protein, 17 aa, Artificial Sequence
  Description of Artificial Sequence: Synthetic peptide
  XENP019442 vhCDR2
FISYDGNNKYYADSVKG

SEQ ID NO: 4553 - protein, 9 aa, Artificial Sequence
  Description of Artificial Sequence: Synthetic peptide
  XENP019442 vhCDR3
TGWLGPFDY

SEQ ID NO: 4554 - protein, 215 aa, Artificial Sequence
  Description of Artificial Sequence: Synthetic polypeptide
  XENP019442 [CTLA-4]_H0_L0.27_Fab Light Chain
EIVLTQSPGTLSLSPGERATLSCRASQSVGQSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4555 - protein, 108 aa, Artificial Sequence; identical to SEQ ID NO: 1652
  Description of Artificial Sequence: Synthetic polypeptide
  VL of XENP019442

SEQ ID NO: 4556 - protein, 12 aa, Artificial Sequence
  Description of Artificial Sequence: Synthetic peptide
  XENP019442 vlCDR1
RASQSVGQSYLA

SEQ ID NO: 4557 - protein, 7 aa, Artificial Sequence
  Description of Artificial Sequence: Synthetic peptide
  XENP019442 vlCDR2
GAFSRAT

SEQ ID NO: 4558 - protein, 9 aa, Artificial Sequence
  Description of Artificial Sequence: Synthetic peptide
  XENP019442 vlCDR3
QQYGSSPWT

SEQ ID NO: 4559 - protein, 221 aa, Artificial Sequence; identical to SEQ ID NO: 2919
  Description of Artificial Sequence: Synthetic polypeptide
  XENP019443 [CTLA-4]_H0_L0.28_Fab Heavy Chain

SEQ ID NO: 4560 - protein, 118 aa, Artificial Sequence; identical to SEQ ID NO: 22
  Description of Artificial Sequence: Synthetic polypeptide
  VH of XENP019443

SEQ ID NO: 4561 - protein, 5 aa, Artificial Sequence
  Description of Artificial Sequence: Synthetic peptide
  XENP019443 vhCDR1
SYTMH

SEQ ID NO: 4562 - protein, 17 aa, Artificial Sequence
  Description of Artificial Sequence: Synthetic peptide
  XENP019443 vhCDR2
FISYDGNNKYYADSVKG

SEQ ID NO: 4563 - protein, 9 aa, Artificial Sequence
  Description of Artificial Sequence: Synthetic peptide
  XENP019443 vhCDR3
TGWLGPFDY

SEQ ID NO: 4564 - protein, 215 aa, Artificial Sequence
  Description of Artificial Sequence: Synthetic polypeptide
  XENP019443 [CTLA-4]_H0_L0.28_Fab Light Chain
EIVLTQSPGTLSLSPGERATLSCRASQSVGTSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4565 - protein, 108 aa, Artificial Sequence; identical to SEQ ID NO: 1661
  Description of Artificial Sequence: Synthetic polypeptide
  VL of XENP019443

SEQ ID NO: 4566 - protein, 12 aa, Artificial Sequence
  Description of Artificial Sequence: Synthetic peptide
  XENP019443 vlCDR1
RASQSVGTSYLA

SEQ ID NO: 4567 - protein, 7 aa, Artificial Sequence
  Description of Artificial Sequence: Synthetic peptide
  XENP019443 vlCDR2
GAFSRAT

SEQ ID NO: 4568 - protein, 9 aa, Artificial Sequence
  Description of Artificial Sequence: Synthetic peptide
  XENP019443 vlCDR3
QQYGSSPWT

SEQ ID NO: 4569 - protein, 221 aa, Artificial Sequence; identical to SEQ ID NO: 2919
  Description of Artificial Sequence: Synthetic polypeptide
  XENP019444 [CTLA-4]_H0_L0.29_Fab Heavy Chain

SEQ ID NO: 4570 - protein, 118 aa, Artificial Sequence; identical to SEQ ID NO: 22
  Description of Artificial Sequence: Synthetic polypeptide
  VH of XENP019444

SEQ ID NO: 4571 - protein, 5 aa, Artificial Sequence
  Description of Artificial Sequence: Synthetic peptide
  XENP019444 vhCDR1
SYTMH

SEQ ID NO: 4572 - protein, 17 aa, Artificial Sequence
  Description of Artificial Sequence: Synthetic peptide
  XENP019444 vhCDR2
FISYDGNNKYYADSVKG

SEQ ID NO: 4573 - protein, 9 aa, Artificial Sequence
  Description of Artificial Sequence: Synthetic peptide
  XENP019444 vhCDR3
TGWLGPFDY

SEQ ID NO: 4574 - protein, 215 aa, Artificial Sequence
  Description of Artificial Sequence: Synthetic polypeptide
  XENP019444 [CTLA-4]_H0_L0.29_Fab Light Chain
EIVLTQSPGTLSLSPGERATLSCRASQSVGSAYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4575 - protein, 108 aa, Artificial Sequence; identical to SEQ ID NO: 1670
  Description of Artificial Sequence: Synthetic polypeptide
  VL of XENP019444

SEQ ID NO: 4576 - protein, 12 aa, Artificial Sequence
  Description of Artificial Sequence: Synthetic peptide
  XENP019444 vlCDR1
RASQSVGSAYLA

SEQ ID NO: 4577 - protein, 7 aa, Artificial Sequence
  Description of Artificial Sequence: Synthetic peptide
  XENP019444 vlCDR2
GAFSRAT

SEQ ID NO: 4578 - protein, 9 aa, Artificial Sequence
  Description of Artificial Sequence: Synthetic peptide
  XENP019444 vlCDR3
QQYGSSPWT

SEQ ID NO: 4579 - protein, 221 aa, Artificial Sequence; identical to SEQ ID NO: 2919
  Description of Artificial Sequence: Synthetic polypeptide
  XENP019445 [CTLA-4]_H0_L0.30_Fab Heavy Chain

SEQ ID NO: 4580 - protein, 118 aa, Artificial Sequence; identical to SEQ ID NO: 22
  Description of Artificial Sequence: Synthetic polypeptide
  VH of XENP019445

SEQ ID NO: 4581 - protein, 5 aa, Artificial Sequence
  Description of Artificial Sequence: Synthetic peptide
  XENP019445 vhCDR1
SYTMH

SEQ ID NO: 4582 - protein, 17 aa, Artificial Sequence
  Description of Artificial Sequence: Synthetic peptide
  XENP019445 vhCDR2
FISYDGNNKYYADSVKG

SEQ ID NO: 4583 - protein, 9 aa, Artificial Sequence
  Description of Artificial Sequence: Synthetic peptide
  XENP019445 vhCDR3
TGWLGPFDY

SEQ ID NO: 4584 - protein, 215 aa, Artificial Sequence
  Description of Artificial Sequence: Synthetic polypeptide
  XENP019445 [CTLA-4]_H0_L0.30_Fab Light Chain
EIVLTQSPGTLSLSPGERATLSCRASQSVGSGYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4585 - protein, 108 aa, Artificial Sequence; identical to SEQ ID NO: 1679
  Description of Artificial Sequence: Synthetic polypeptide
  VL of XENP019445

SEQ ID NO: 4586 - protein, 12 aa, Artificial Sequence
  Description of Artificial Sequence: Synthetic peptide
  XENP019445 vlCDR1
RASQSVGSGYLA

SEQ ID NO: 4587 - protein, 7 aa, Artificial Sequence
  Description of Artificial Sequence: Synthetic peptide
  XENP019445 vlCDR2
GAFSRAT

SEQ ID NO: 4588 - protein, 9 aa, Artificial Sequence
  Description of Artificial Sequence: Synthetic peptide
  XENP019445 vlCDR3
QQYGSSPWT

SEQ ID NO: 4589 - protein, 221 aa, Artificial Sequence; identical to SEQ ID NO: 2919
  Description of Artificial Sequence: Synthetic polypeptide
  XENP019446 [CTLA-4]_H0_L0.31_Fab Heavy Chain

SEQ ID NO: 4590 - protein, 118 aa, Artificial Sequence; identical to SEQ ID NO: 22
  Description of Artificial Sequence: Synthetic polypeptide
  VH of XENP019446

SEQ ID NO: 4591 - protein, 5 aa, Artificial Sequence
  Description of Artificial Sequence: Synthetic peptide
  XENP019446 vhCDR1
SYTMH

SEQ ID NO: 4592 - protein, 17 aa, Artificial Sequence
  Description of Artificial Sequence: Synthetic peptide
  XENP019446 vhCDR2
FISYDGNNKYYADSVKG

SEQ ID NO: 4593 - protein, 9 aa, Artificial Sequence
  Description of Artificial Sequence: Synthetic peptide
  XENP019446 vhCDR3
TGWLGPFDY

SEQ ID NO: 4594 - protein, 215 aa, Artificial Sequence
  Description of Artificial Sequence: Synthetic polypeptide
  XENP019446 [CTLA-4]_H0_L0.31_Fab Light Chain
EIVLTQSPGTLSLSPGERATLSCRASQSVGSNYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4595 - protein, 108 aa, Artificial Sequence; identical to SEQ ID NO: 1688
  Description of Artificial Sequence: Synthetic polypeptide
  VL of XENP019446

SEQ ID NO: 4596 - protein, 12 aa, Artificial Sequence
  Description of Artificial Sequence: Synthetic peptide
  XENP019446 vlCDR1
RASQSVGSNYLA

SEQ ID NO: 4597 - protein, 7 aa, Artificial Sequence
  Description of Artificial Sequence: Synthetic peptide
  XENP019446 vlCDR2
GAFSRAT

SEQ ID NO: 4598 - protein, 9 aa, Artificial Sequence
  Description of Artificial Sequence: Synthetic peptide
  XENP019446 vlCDR3
QQYGSSPWT

SEQ ID NO: 4599 - protein, 221 aa, Artificial Sequence; identical to SEQ ID NO: 2919
  Description of Artificial Sequence: Synthetic polypeptide
  XENP019447 [CTLA-4]_H0_L0.32_Fab Heavy Chain

SEQ ID NO: 4600 - protein, 118 aa, Artificial Sequence; identical to SEQ ID NO: 22
  Description of Artificial Sequence: Synthetic polypeptide
  VH of XENP019447

SEQ ID NO: 4601 - protein, 5 aa, Artificial Sequence
  Description of Artificial Sequence: Synthetic peptide
  XENP019447 vhCDR1
SYTMH

SEQ ID NO: 4602 - protein, 17 aa, Artificial Sequence
  Description of Artificial Sequence: Synthetic peptide
  XENP019447 vhCDR2
FISYDGNNKYYADSVKG

SEQ ID NO: 4603 - protein, 9 aa, Artificial Sequence
  Description of Artificial Sequence: Synthetic peptide
  XENP019447 vhCDR3
TGWLGPFDY

SEQ ID NO: 4604 - protein, 215 aa, Artificial Sequence
  Description of Artificial Sequence: Synthetic polypeptide
  XENP019447 [CTLA-4]_H0_L0.32_Fab Light Chain
EIVLTQSPGTLSLSPGERATLSCRASQSVGSQYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4605 - protein, 108 aa, Artificial Sequence; identical to SEQ ID NO: 1697
  Description of Artificial Sequence: Synthetic polypeptide
  VL of XENP019447

SEQ ID NO: 4606 - protein, 12 aa, Artificial Sequence
  Description of Artificial Sequence: Synthetic peptide
  XENP019447 vlCDR1
RASQSVGSQYLA

SEQ ID NO: 4607 - protein, 7 aa, Artificial Sequence
  Description of Artificial Sequence: Synthetic peptide
  XENP019447 vlCDR2
GAFSRAT

SEQ ID NO: 4608 - protein, 9 aa, Artificial Sequence
  Description of Artificial Sequence: Synthetic peptide
  XENP019447 vlCDR3
QQYGSSPWT

SEQ ID NO: 4609 - protein, 221 aa, Artificial Sequence; identical to SEQ ID NO: 2919
  Description of Artificial Sequence: Synthetic polypeptide
  XENP019448 [CTLA-4]_H0_L0.33_Fab Heavy Chain

SEQ ID NO: 4610 - protein, 118 aa, Artificial Sequence; identical to SEQ ID NO: 22
  Description of Artificial Sequence: Synthetic polypeptide
  VH of XENP019448

SEQ ID NO: 4611 - protein, 5 aa, Artificial Sequence
  Description of Artificial Sequence: Synthetic peptide
  XENP019448 vhCDR1
SYTMH

SEQ ID NO: 4612 - protein, 17 aa, Artificial Sequence
  Description of Artificial Sequence: Synthetic peptide
  XENP019448 vhCDR2
FISYDGNNKYYADSVKG

SEQ ID NO: 4613 - protein, 9 aa, Artificial Sequence
  Description of Artificial Sequence: Synthetic peptide
  XENP019448 vhCDR3
TGWLGPFDY

SEQ ID NO: 4614 - protein, 215 aa, Artificial Sequence
  Description of Artificial Sequence: Synthetic polypeptide
  XENP019448 [CTLA-4]_H0_L0.33_Fab Light Chain
EIVLTQSPGTLSLSPGERATLSCRASQSVGSTYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4615 - protein, 108 aa, Artificial Sequence; identical to SEQ ID NO: 1706
  Description of Artificial Sequence: Synthetic polypeptide
  VL of XENP019448

SEQ ID NO: 4616 - protein, 12 aa, Artificial Sequence
  Description of Artificial Sequence: Synthetic peptide
  XENP019448 vlCDR1
RASQSVGSTYLA

SEQ ID NO: 4617 - protein, 7 aa, Artificial Sequence
  Description of Artificial Sequence: Synthetic peptide
  XENP019448 vlCDR2
GAFSRAT

SEQ ID NO: 4618 - protein, 9 aa, Artificial Sequence
  Description of Artificial Sequence: Synthetic peptide
  XENP019448 vlCDR3
QQYGSSPWT

SEQ ID NO: 4619 - protein, 221 aa, Artificial Sequence; identical to SEQ ID NO: 2919
  Description of Artificial Sequence: Synthetic polypeptide
  XENP019449 [CTLA-4]_H0_L0.34_Fab Heavy Chain

SEQ ID NO: 4620 - protein, 118 aa, Artificial Sequence; identical to SEQ ID NO: 22
  Description of Artificial Sequence: Synthetic polypeptide
  VH of XENP019449

SEQ ID NO: 4621 - protein, 5 aa, Artificial Sequence
  Description of Artificial Sequence: Synthetic peptide
  XENP019449 vhCDR1
SYTMH

SEQ ID NO: 4622 - protein, 17 aa, Artificial Sequence
  Description of Artificial Sequence: Synthetic peptide
  XENP019449 vhCDR2
FISYDGNNKYYADSVKG

SEQ ID NO: 4623 - protein, 9 aa, Artificial Sequence
  Description of Artificial Sequence: Synthetic peptide
  XENP019449 vhCDR3
TGWLGPFDY

SEQ ID NO: 4624 - protein, 215 aa, Artificial Sequence
  Description of Artificial Sequence: Synthetic polypeptide
  XENP019449 [CTLA-4]_H0_L0.34_Fab Light Chain
EIVLTQSPGTLSLSPGERATLSCRASQSVGSSALAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4625 - protein, 108 aa, Artificial Sequence; identical to SEQ ID NO: 1715
  Description of Artificial Sequence: Synthetic polypeptide
  VL of XENP019449

SEQ ID NO: 4626 - protein, 12 aa, Artificial Sequence
  Description of Artificial Sequence: Synthetic peptide
  XENP019449 vlCDR1
RASQSVGSSALA

SEQ ID NO: 4627 - protein, 7 aa, Artificial Sequence
  Description of Artificial Sequence: Synthetic peptide
  XENP019449 vlCDR2
GAFSRAT

SEQ ID NO: 4628 - protein, 9 aa, Artificial Sequence
  Description of Artificial Sequence: Synthetic peptide
  XENP019449 vlCDR3
QQYGSSPWT

SEQ ID NO: 4629 - protein, 221 aa, Artificial Sequence; identical to SEQ ID NO: 2919
  Description of Artificial Sequence: Synthetic polypeptide
  XENP019450 [CTLA-4]_H0_L0.35_Fab Heavy Chain

SEQ ID NO: 4630 - protein, 118 aa, Artificial Sequence; identical to SEQ ID NO: 22
  Description of Artificial Sequence: Synthetic polypeptide
  VH of XENP019450

SEQ ID NO: 4631 - protein, 5 aa, Artificial Sequence
  Description of Artificial Sequence: Synthetic peptide
  XENP019450 vhCDR1
SYTMH

SEQ ID NO: 4632 - protein, 17 aa, Artificial Sequence
  Description of Artificial Sequence: Synthetic peptide
  XENP019450 vhCDR2
FISYDGNNKYYADSVKG

SEQ ID NO: 4633 - protein, 9 aa, Artificial Sequence
  Description of Artificial Sequence: Synthetic peptide
  XENP019450 vhCDR3
TGWLGPFDY

SEQ ID NO: 4634 - protein, 215 aa, Artificial Sequence
  Description of Artificial Sequence: Synthetic polypeptide
  XENP019450 [CTLA-4]_H0_L0.35_Fab Light Chain
EIVLTQSPGTLSLSPGERATLSCRASQSVGSSFLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4635 - protein, 108 aa, Artificial Sequence; identical to SEQ ID NO: 1724
  Description of Artificial Sequence: Synthetic polypeptide
  VL of XENP019450

SEQ ID NO: 4636 - protein, 12 aa, Artificial Sequence
  Description of Artificial Sequence: Synthetic peptide
  XENP019450 vlCDR1
RASQSVGSSFLA

SEQ ID NO: 4637 - protein, 7 aa, Artificial Sequence
  Description of Artificial Sequence: Synthetic peptide
  XENP019450 vlCDR2
GAFSRAT

SEQ ID NO: 4638 - protein, 9 aa, Artificial Sequence
  Description of Artificial Sequence: Synthetic peptide
  XENP019450 vlCDR3
QQYGSSPWT

SEQ ID NO: 4639 - protein, 221 aa, Artificial Sequence; identical to SEQ ID NO: 2919
  Description of Artificial Sequence: Synthetic polypeptide
  XENP019451 [CTLA-4]_H0_L0.36_Fab Heavy Chain

SEQ ID NO: 4640 - protein, 118 aa, Artificial Sequence; identical to SEQ ID NO: 22
  Description of Artificial Sequence: Synthetic polypeptide
  VH of XENP019451

SEQ ID NO: 4641 - protein, 5 aa, Artificial Sequence
  Description of Artificial Sequence: Synthetic peptide
  XENP019451 vhCDR1
SYTMH

SEQ ID NO: 4642 - protein, 17 aa, Artificial Sequence
  Description of Artificial Sequence: Synthetic peptide
  XENP019451 vhCDR2
FISYDGNNKYYADSVKG

SEQ ID NO: 4643 - protein, 9 aa, Artificial Sequence
  Description of Artificial Sequence: Synthetic peptide
  XENP019451 vhCDR3
TGWLGPFDY

SEQ ID NO: 4644 - protein, 215 aa, Artificial Sequence
  Description of Artificial Sequence: Synthetic polypeptide
  XENP019451 [CTLA-4]_H0_L0.36_Fab Light Chain
EIVLTQSPGTLSLSPGERATLSCRASQSVGSSHLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4645 - protein, 108 aa, Artificial Sequence; identical to SEQ ID NO: 1733
  Description of Artificial Sequence: Synthetic polypeptide
  VL of XENP019451

SEQ ID NO: 4646 - protein, 12 aa, Artificial Sequence
  Description of Artificial Sequence: Synthetic peptide
  XENP019451 vlCDR1
RASQSVGSSHLA

SEQ ID NO: 4647 - protein, 7 aa, Artificial Sequence
  Description of Artificial Sequence: Synthetic peptide
  XENP019451 vlCDR2
GAFSRAT

SEQ ID NO: 4648 - protein, 9 aa, Artificial Sequence
  Description of Artificial Sequence: Synthetic peptide
  XENP019451 vlCDR3
QQYGSSPWT

SEQ ID NO: 4649 - protein, 221 aa, Artificial Sequence; identical to SEQ ID NO: 2919
  Description of Artificial Sequence: Synthetic polypeptide
  XENP019452 [CTLA-4]_H0_L0.37_Fab Heavy Chain

SEQ ID NO: 4650 - protein, 118 aa, Artificial Sequence; identical to SEQ ID NO: 22
  Description of Artificial Sequence: Synthetic polypeptide
  VH of XENP019452

SEQ ID NO: 4651 - protein, 5 aa, Artificial Sequence
  Description of Artificial Sequence: Synthetic peptide
  XENP019452 vhCDR1
SYTMH

SEQ ID NO: 4652 - protein, 17 aa, Artificial Sequence
  Description of Artificial Sequence: Synthetic peptide
  XENP019452 vhCDR2
FISYDGNNKYYADSVKG

SEQ ID NO: 4653 - protein, 9 aa, Artificial Sequence
  Description of Artificial Sequence: Synthetic peptide
  XENP019452 vhCDR3
TGWLGPFDY

SEQ ID NO: 4654 - protein, 215 aa, Artificial Sequence
  Description of Artificial Sequence: Synthetic polypeptide
  XENP019452 [CTLA-4]_H0_L0.37_Fab Light Chain
EIVLTQSPGTLSLSPGERATLSCRASQSVGSSLLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4655 - protein, 108 aa, Artificial Sequence; identical to SEQ ID NO: 1742
  Description of Artificial Sequence: Synthetic polypeptide
  VL of XENP019452

SEQ ID NO: 4656 - protein, 12 aa, Artificial Sequence
  Description of Artificial Sequence: Synthetic peptide
  XENP019452 vlCDR1
RASQSVGSSLLA

SEQ ID NO: 4657 - protein, 7 aa, Artificial Sequence
  Description of Artificial Sequence: Synthetic peptide
  XENP019452 vlCDR2
GAFSRAT

SEQ ID NO: 4658 - protein, 9 aa, Artificial Sequence
  Description of Artificial Sequence: Synthetic peptide
  XENP019452 vlCDR3
QQYGSSPWT

SEQ ID NO: 4659 - protein, 221 aa, Artificial Sequence; identical to SEQ ID NO: 2919
  Description of Artificial Sequence: Synthetic polypeptide
  XENP019453 [CTLA-4]_H0_L0.38_Fab Heavy Chain

SEQ ID NO: 4660 - protein, 118 aa, Artificial Sequence; identical to SEQ ID NO: 22
  Description of Artificial Sequence: Synthetic polypeptide
  VH of XENP019453

SEQ ID NO: 4661 - protein, 5 aa, Artificial Sequence
  Description of Artificial Sequence: Synthetic peptide
  XENP019453 vhCDR1
SYTMH

SEQ ID NO: 4662 - protein, 17 aa, Artificial Sequence
  Description of Artificial Sequence: Synthetic peptide
  XENP019453 vhCDR2
FISYDGNNKYYADSVKG

SEQ ID NO: 4663 - protein, 9 aa, Artificial Sequence
  Description of Artificial Sequence: Synthetic peptide
  XENP019453 vhCDR3
TGWLGPFDY

SEQ ID NO: 4664 - protein, 215 aa, Artificial Sequence
  Description of Artificial Sequence: Synthetic polypeptide
  XENP019453 [CTLA-4]_H0_L0.38_Fab Light Chain
EIVLTQSPGTLSLSPGERATLSCRASQSVGSSNLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4665 - protein, 108 aa, Artificial Sequence; identical to SEQ ID NO: 1751
  Description of Artificial Sequence: Synthetic polypeptide
  VL of XENP019453

SEQ ID NO: 4666 - protein, 12 aa, Artificial Sequence
  Description of Artificial Sequence: Synthetic peptide
  XENP019453 vlCDR1
RASQSVGSSNLA

SEQ ID NO: 4667 - protein, 7 aa, Artificial Sequence
  Description of Artificial Sequence: Synthetic peptide
  XENP019453 vlCDR2
GAFSRAT

SEQ ID NO: 4668 - protein, 9 aa, Artificial Sequence
  Description of Artificial Sequence: Synthetic peptide
  XENP019453 vlCDR3
QQYGSSPWT

SEQ ID NO: 4669 - protein, 221 aa, Artificial Sequence; identical to SEQ ID NO: 2919
  Description of Artificial Sequence: Synthetic polypeptide
  XENP019454 [CTLA-4]_H0_L0.39_Fab Heavy Chain

SEQ ID NO: 4670 - protein, 118 aa, Artificial Sequence; identical to SEQ ID NO: 22
  Description of Artificial Sequence: Synthetic polypeptide
  VH of XENP019454

SEQ ID NO: 4671 - protein, 5 aa, Artificial Sequence
  Description of Artificial Sequence: Synthetic peptide
  XENP019454 vhCDR1
SYTMH

SEQ ID NO: 4672 - protein, 17 aa, Artificial Sequence
  Description of Artificial Sequence: Synthetic peptide
  XENP019454 vhCDR2
FISYDGNNKYYADSVKG

SEQ ID NO: 4673 - protein, 9 aa, Artificial Sequence
  Description of Artificial Sequence: Synthetic peptide
  XENP019454 vhCDR3
TGWLGPFDY

SEQ ID NO: 4674 - protein, 215 aa, Artificial Sequence
  Description of Artificial Sequence: Synthetic polypeptide
  XENP019454 [CTLA-4]_H0_L0.39_Fab Light Chain
EIVLTQSPGTLSLSPGERATLSCRASQSVGSSSLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4675 - protein, 108 aa, Artificial Sequence; identical to SEQ ID NO: 1760
  Description of Artificial Sequence: Synthetic polypeptide
  VL of XENP019454

SEQ ID NO: 4676 - protein, 12 aa, Artificial Sequence
  Description of Artificial Sequence: Synthetic peptide
  XENP019454 vlCDR1
RASQSVGSSSLA

SEQ ID NO: 4677 - protein, 7 aa, Artificial Sequence
  Description of Artificial Sequence: Synthetic peptide
  XENP019454 vlCDR2
GAFSRAT

SEQ ID NO: 4678 - protein, 9 aa, Artificial Sequence
  Description of Artificial Sequence: Synthetic peptide
  XENP019454 vlCDR3
QQYGSSPWT

SEQ ID NO: 4679 - protein, 221 aa, Artificial Sequence; identical to SEQ ID NO: 2919
  Description of Artificial Sequence: Synthetic polypeptide
  XENP019455 [CTLA-4]_H0_L0.40_Fab Heavy Chain

SEQ ID NO: 4680 - protein, 118 aa, Artificial Sequence; identical to SEQ ID NO: 22
  Description of Artificial Sequence: Synthetic polypeptide
  VH of XENP019455

SEQ ID NO: 4681 - protein, 5 aa, Artificial Sequence
  Description of Artificial Sequence: Synthetic peptide
  XENP019455 vhCDR1
SYTMH

SEQ ID NO: 4682 - protein, 17 aa, Artificial Sequence
  Description of Artificial Sequence: Synthetic peptide
  XENP019455 vhCDR2
FISYDGNNKYYADSVKG

SEQ ID NO: 4683 - protein, 9 aa, Artificial Sequence
  Description of Artificial Sequence: Synthetic peptide
  XENP019455 vhCDR3
TGWLGPFDY

SEQ ID NO: 4684 - protein, 215 aa, Artificial Sequence
  Description of Artificial Sequence: Synthetic polypeptide
  XENP019455 [CTLA-4]_H0_L0.40_Fab Light Chain
EIVLTQSPGTLSLSPGERATLSCRASQSVGSSVLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4685 - protein, 108 aa, Artificial Sequence; identical to SEQ ID NO: 1769
  Description of Artificial Sequence: Synthetic polypeptide
  VL of XENP019455

SEQ ID NO: 4686 - protein, 12 aa, Artificial Sequence
  Description of Artificial Sequence: Synthetic peptide
  XENP019455 vlCDR1
RASQSVGSSVLA

SEQ ID NO: 4687 - protein, 7 aa, Artificial Sequence
  Description of Artificial Sequence: Synthetic peptide
  XENP019455 vlCDR2
GAFSRAT

SEQ ID NO: 4688 - protein, 9 aa, Artificial Sequence
  Description of Artificial Sequence: Synthetic peptide
  XENP019455 vlCDR3
QQYGSSPWT

SEQ ID NO: 4689 - protein, 221 aa, Artificial Sequence; identical to SEQ ID NO: 2919
  Description of Artificial Sequence: Synthetic polypeptide
  XENP019456 [CTLA-4]_H0_L0.41_Fab Heavy Chain

SEQ ID NO: 4690 - protein, 118 aa, Artificial Sequence; identical to SEQ ID NO: 22
  Description of Artificial Sequence: Synthetic polypeptide
  VH of XENP019456

SEQ ID NO: 4691 - protein, 5 aa, Artificial Sequence
  Description of Artificial Sequence: Synthetic peptide
  XENP019456 vhCDR1
SYTMH

SEQ ID NO: 4692 - protein, 17 aa, Artificial Sequence
  Description of Artificial Sequence: Synthetic peptide
  XENP019456 vhCDR2
FISYDGNNKYYADSVKG

SEQ ID NO: 4693 - protein, 9 aa, Artificial Sequence
  Description of Artificial Sequence: Synthetic peptide
  XENP019456 vhCDR3
TGWLGPFDY

SEQ ID NO: 4694 - protein, 215 aa, Artificial Sequence
  Description of Artificial Sequence: Synthetic polypeptide
  XENP019456 [CTLA-4]_H0_L0.41_Fab Light Chain
EIVLTQSPGTLSLSPGERATLSCRASQSVGSSYMAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4695 - protein, 108 aa, Artificial Sequence; identical to SEQ ID NO: 1778
  Description of Artificial Sequence: Synthetic polypeptide
  VL of XENP019456

SEQ ID NO: 4696 - protein, 12 aa, Artificial Sequence
  Description of Artificial Sequence: Synthetic peptide
  XENP019456 vlCDR1
RASQSVGSSYMA

SEQ ID NO: 4697 - protein, 7 aa, Artificial Sequence
  Description of Artificial Sequence: Synthetic peptide
  XENP019456 vlCDR2
GAFSRAT

SEQ ID NO: 4698 - protein, 9 aa, Artificial Sequence
  Description of Artificial Sequence: Synthetic peptide
  XENP019456 vlCDR3
QQYGSSPWT

SEQ ID NO: 4699 - protein, 221 aa, Artificial Sequence; identical to SEQ ID NO: 2919
  Description of Artificial Sequence: Synthetic polypeptide
  XENP019457 [CTLA-4]_H0_L0.42_Fab Heavy Chain

SEQ ID NO: 4700 - protein, 118 aa, Artificial Sequence; identical to SEQ ID NO: 22
  Description of Artificial Sequence: Synthetic polypeptide
  VH of XENP019457

SEQ ID NO: 4701 - protein, 5 aa, Artificial Sequence
  Description of Artificial Sequence: Synthetic peptide
  XENP019457 vhCDR1
SYTMH

SEQ ID NO: 4702 - protein, 17 aa, Artificial Sequence
  Description of Artificial Sequence: Synthetic peptide
  XENP019457 vhCDR2
FISYDGNNKYYADSVKG

SEQ ID NO: 4703 - protein, 9 aa, Artificial Sequence
  Description of Artificial Sequence: Synthetic peptide
  XENP019457 vhCDR3
TGWLGPFDY

SEQ ID NO: 4704 - protein, 215 aa, Artificial Sequence
  Description of Artificial Sequence: Synthetic polypeptide
  XENP019457 [CTLA-4]_H0_L0.42_Fab Light Chain
EIVLTQSPGTLSLSPGERATLSCRASQSVGSSYLDWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4705 - protein, 108 aa, Artificial Sequence; identical to SEQ ID NO: 1787
  Description of Artificial Sequence: Synthetic polypeptide
  VL of XENP019457

SEQ ID NO: 4706 - protein, 12 aa, Artificial Sequence
  Description of Artificial Sequence: Synthetic peptide
  XENP019457 vlCDR1
RASQSVGSSYLD

SEQ ID NO: 4707 - protein, 7 aa, Artificial Sequence
  Description of Artificial Sequence: Synthetic peptide
  XENP019457 vlCDR2
GAFSRAT

SEQ ID NO: 4708 - protein, 9 aa, Artificial Sequence
  Description of Artificial Sequence: Synthetic peptide
  XENP019457 vlCDR3
QQYGSSPWT

SEQ ID NO: 4709 - protein, 221 aa, Artificial Sequence; identical to SEQ ID NO: 2919
  Description of Artificial Sequence: Synthetic polypeptide
  XENP019458 [CTLA-4]_H0_L0.43_Fab Heavy Chain

SEQ ID NO: 4710 - protein, 118 aa, Artificial Sequence; identical to SEQ ID NO: 22
  Description of Artificial Sequence: Synthetic polypeptide
  VH of XENP019458

SEQ ID NO: 4711 - protein, 5 aa, Artificial Sequence
  Description of Artificial Sequence: Synthetic peptide
  XENP019458 vhCDR1
SYTMH

SEQ ID NO: 4712 - protein, 17 aa, Artificial Sequence
  Description of Artificial Sequence: Synthetic peptide
  XENP019458 vhCDR2
FISYDGNNKYYADSVKG

SEQ ID NO: 4713 - protein, 9 aa, Artificial Sequence
  Description of Artificial Sequence: Synthetic peptide
  XENP019458 vhCDR3
TGWLGPFDY

SEQ ID NO: 4714 - protein, 215 aa, Artificial Sequence
  Description of Artificial Sequence: Synthetic polypeptide
  XENP019458 [CTLA-4]_H0_L0.43_Fab Light Chain
EIVLTQSPGTLSLSPGERATLSCRASQSVGSSYLDWYQQKPGQAPRLLIYGAFSRATGIPDRFSGSGSGTDFTLTISRLEPEDFAVYYCKQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4715 - protein, 108 aa, Artificial Sequence; identical to SEQ ID NO: 1796
  Description of Artificial Sequence: Synthetic polypeptide
  VL of XENP019458

SEQ ID NO: 4716 - protein, 12 aa, Artificial Sequence
  Description of Artificial Sequence: Synthetic peptide
  XENP019458 vlCDR1
RASQSVGSSYLD

SEQ ID NO: 4717 - protein, 7 aa, Artificial Sequence
  Description of Artificial Sequence: Synthetic peptide
  XENP019458 vlCDR2
GAFSRAT

SEQ ID NO: 4718 - protein, 9 aa, Artificial Sequence
  Description of Artificial Sequence: Synthetic peptide
  XENP019458 vlCDR3
KQYGSSPWT

SEQ ID NO: 4719 - protein, 221 aa, Artificial Sequence; identical to SEQ ID NO: 2919
  Description of Artificial Sequence: Synthetic polypeptide
  XENP019459 [CTLA-4]_H0_L0.44_Fab Heavy Chain

SEQ ID NO: 4720 - protein, 118 aa, Artificial Sequence; identical to SEQ ID NO: 22
  Description of Artificial Sequence: Synthetic polypeptide
  VH of XENP019459

SEQ ID NO: 4721 - protein, 5 aa, Artificial Sequence
  Description of Artificial Sequence: Synthetic peptide
  XENP019459 vhCDR1
SYTMH

SEQ ID NO: 4722 - protein, 17 aa, Artificial Sequence
  Description of Artificial Sequence: Synthetic peptide
  XENP019459 vhCDR2
FISYDGNNKYYADSVKG

SEQ ID NO: 4723 - protein, 9 aa, Artificial Sequence
  Description of Artificial Sequence: Synthetic peptide
  XENP019459 vhCDR3
TGWLGPFDY

SEQ ID NO: 4724 - protein, 215 aa, Artificial Sequence
  Description of Artificial Sequence: Synthetic polypeptide
  XENP019459 [CTLA-4]_H0_L0.44_Fab Light Chain
EIVLTQSPGTLSLSPGERATLSCRASQSVGSSYLSWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4725 - protein, 108 aa, Artificial Sequence; identical to SEQ ID NO: 1805
  Description of Artificial Sequence: Synthetic polypeptide
  VL of XENP019459

SEQ ID NO: 4726 - protein, 12 aa, Artificial Sequence
  Description of Artificial Sequence: Synthetic peptide
  XENP019459 vlCDR1
RASQSVGSSYLS

SEQ ID NO: 4727 - protein, 7 aa, Artificial Sequence
  Description of Artificial Sequence: Synthetic peptide
  XENP019459 vlCDR2
GAFSRAT

SEQ ID NO: 4728 - protein, 9 aa, Artificial Sequence
  Description of Artificial Sequence: Synthetic peptide
  XENP019459 vlCDR3
QQYGSSPWT

SEQ ID NO: 4729 - protein, 221 aa, Artificial Sequence; identical to SEQ ID NO: 2919
  Description of Artificial Sequence: Synthetic polypeptide
  XENP019460 [CTLA-4]_H0_L0.45_Fab Heavy Chain

SEQ ID NO: 4730 - protein, 118 aa, Artificial Sequence; identical to SEQ ID NO: 22
  Description of Artificial Sequence: Synthetic polypeptide
  VH of XENP019460

SEQ ID NO: 4731 - protein, 5 aa, Artificial Sequence
  Description of Artificial Sequence: Synthetic peptide
  XENP019460 vhCDR1
SYTMH

SEQ ID NO: 4732 - protein, 17 aa, Artificial Sequence
  Description of Artificial Sequence: Synthetic peptide
  XENP019460 vhCDR2
FISYDGNNKYYADSVKG

SEQ ID NO: 4733 - protein, 9 aa, Artificial Sequence
  Description of Artificial Sequence: Synthetic peptide
  XENP019460 vhCDR3
TGWLGPFDY

SEQ ID NO: 4734 - protein, 215 aa, Artificial Sequence
  Description of Artificial Sequence: Synthetic polypeptide
  XENP019460 [CTLA-4]_H0_L0.45_Fab Light Chain
EIVLTQSPGTLSLSPGERATLSCRASQSVGSSYLTWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4735 - protein, 108 aa, Artificial Sequence; identical to SEQ ID NO: 1814
  Description of Artificial Sequence: Synthetic polypeptide
  VL of XENP019460

SEQ ID NO: 4736 - protein, 12 aa, Artificial Sequence
  Description of Artificial Sequence: Synthetic peptide
  XENP019460 vlCDR1
RASQSVGSSYLT

SEQ ID NO: 4737 - protein, 7 aa, Artificial Sequence
  Description of Artificial Sequence: Synthetic peptide
  XENP019460 vlCDR2
GAFSRAT

SEQ ID NO: 4738 - protein, 9 aa, Artificial Sequence
  Description of Artificial Sequence: Synthetic peptide
  XENP019460 vlCDR3
QQYGSSPWT

SEQ ID NO: 4739 - protein, 221 aa, Artificial Sequence; identical to SEQ ID NO: 2919
  Description of Artificial Sequence: Synthetic polypeptide
  XENP019461 [CTLA-4]_H0_L0.46_Fab Heavy Chain

SEQ ID NO: 4740 - protein, 118 aa, Artificial Sequence; identical to SEQ ID NO: 22
  Description of Artificial Sequence: Synthetic polypeptide
  VH of XENP019461

SEQ ID NO: 4741 - protein, 5 aa, Artificial Sequence
  Description of Artificial Sequence: Synthetic peptide
  XENP019461 vhCDR1
SYTMH

SEQ ID NO: 4742 - protein, 17 aa, Artificial Sequence
  Description of Artificial Sequence: Synthetic peptide
  XENP019461 vhCDR2
FISYDGNNKYYADSVKG

SEQ ID NO: 4743 - protein, 9 aa, Artificial Sequence
  Description of Artificial Sequence: Synthetic peptide
  XENP019461 vhCDR3
TGWLGPFDY

SEQ ID NO: 4744 - protein, 215 aa, Artificial Sequence
  Description of Artificial Sequence: Synthetic polypeptide
  XENP019461 [CTLA-4]_H0_L0.46_Fab Light Chain
EIVLTQSPGTLSLSPGERATLSCRASQSVGSSYLAWYEQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4745 - protein, 108 aa, Artificial Sequence; identical to SEQ ID NO: 1823
  Description of Artificial Sequence: Synthetic polypeptide
  VL of XENP019461

SEQ ID NO: 4746 - protein, 12 aa, Artificial Sequence
  Description of Artificial Sequence: Synthetic peptide
  XENP019461 vlCDR1
RASQSVGSSYLA

SEQ ID NO: 4747 - protein, 7 aa, Artificial Sequence
  Description of Artificial Sequence: Synthetic peptide
  XENP019461 vlCDR2
GAFSRAT

SEQ ID NO: 4748 - protein, 9 aa, Artificial Sequence
  Description of Artificial Sequence: Synthetic peptide
  XENP019461 vlCDR3
QQYGSSPWT

SEQ ID NO: 4749 - protein, 221 aa, Artificial Sequence; identical to SEQ ID NO: 2919
  Description of Artificial Sequence: Synthetic polypeptide
  XENP019462 [CTLA-4]_H0_L0.47_Fab Heavy Chain

SEQ ID NO: 4750 - protein, 118 aa, Artificial Sequence; identical to SEQ ID NO: 22
  Description of Artificial Sequence: Synthetic polypeptide
  VH of XENP019462

SEQ ID NO: 4751 - protein, 5 aa, Artificial Sequence
  Description of Artificial Sequence: Synthetic peptide
  XENP019462 vhCDR1
SYTMH

SEQ ID NO: 4752 - protein, 17 aa, Artificial Sequence
  Description of Artificial Sequence: Synthetic peptide
  XENP019462 vhCDR2
FISYDGNNKYYADSVKG

SEQ ID NO: 4753 - protein, 9 aa, Artificial Sequence
  Description of Artificial Sequence: Synthetic peptide
  XENP019462 vhCDR3
TGWLGPFDY

SEQ ID NO: 4754 - protein, 215 aa, Artificial Sequence
  Description of Artificial Sequence: Synthetic polypeptide
  XENP019462 [CTLA-4]_H0_L0.47_Fab Light Chain
EIVLTQSPGTLSLSPGERATLSCRASQSVGSSYLAWYLQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4755 - protein, 108 aa, Artificial Sequence; identical to SEQ ID NO: 1832
  Description of Artificial Sequence: Synthetic polypeptide
  VL of XENP019462

SEQ ID NO: 4756 - protein, 12 aa, Artificial Sequence
  Description of Artificial Sequence: Synthetic peptide
  XENP019462 vlCDR1
RASQSVGSSYLA

SEQ ID NO: 4757 - protein, 7 aa, Artificial Sequence
  Description of Artificial Sequence: Synthetic peptide
  XENP019462 vlCDR2
GAFSRAT

SEQ ID NO: 4758 - protein, 9 aa, Artificial Sequence
  Description of Artificial Sequence: Synthetic peptide
  XENP019462 vlCDR3
QQYGSSPWT

SEQ ID NO: 4759 - protein, 221 aa, Artificial Sequence; identical to SEQ ID NO: 2919
  Description of Artificial Sequence: Synthetic polypeptide
  XENP019463 [CTLA-4]_H0_L0.48_Fab Heavy Chain

SEQ ID NO: 4760 - protein, 118 aa, Artificial Sequence; identical to SEQ ID NO: 22
  Description of Artificial Sequence: Synthetic polypeptide
  VH of XENP019463

SEQ ID NO: 4761 - protein, 5 aa, Artificial Sequence
  Description of Artificial Sequence: Synthetic peptide
  XENP019463 vhCDR1
SYTMH

SEQ ID NO: 4762 - protein, 17 aa, Artificial Sequence
  Description of Artificial Sequence: Synthetic peptide
  XENP019463 vhCDR2
FISYDGNNKYYADSVKG

SEQ ID NO: 4763 - protein, 9 aa, Artificial Sequence
  Description of Artificial Sequence: Synthetic peptide
  XENP019463 vhCDR3
TGWLGPFDY

SEQ ID NO: 4764 - protein, 215 aa, Artificial Sequence
  Description of Artificial Sequence: Synthetic polypeptide
  XENP019463 [CTLA-4]_H0_L0.48_Fab Light Chain
EIVLTQSPGTLSLSPGERATLSCRASQSVGSSYLAWYRQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4765 - protein, 108 aa, Artificial Sequence; identical to SEQ ID NO: 1841
  Description of Artificial Sequence: Synthetic polypeptide
  VL of XENP019463

SEQ ID NO: 4766 - protein, 12 aa, Artificial Sequence
  Description of Artificial Sequence: Synthetic peptide
  XENP019463 vlCDR1
RASQSVGSSYLA

SEQ ID NO: 4767 - protein, 7 aa, Artificial Sequence
  Description of Artificial Sequence: Synthetic peptide
  XENP019463 vlCDR2
GAFSRAT

SEQ ID NO: 4768 - protein, 9 aa, Artificial Sequence
  Description of Artificial Sequence: Synthetic peptide
  XENP019463 vlCDR3
QQYGSSPWT

SEQ ID NO: 4769 - protein, 221 aa, Artificial Sequence; identical to SEQ ID NO: 2919
  Description of Artificial Sequence: Synthetic polypeptide
  XENP019464 [CTLA-4]_H0_L0.49_Fab Heavy Chain

SEQ ID NO: 4770 - protein, 118 aa, Artificial Sequence; identical to SEQ ID NO: 22
  Description of Artificial Sequence: Synthetic polypeptide
  VH of XENP019464

SEQ ID NO: 4771 - protein, 5 aa, Artificial Sequence
  Description of Artificial Sequence: Synthetic peptide
  XENP019464 vhCDR1
SYTMH

SEQ ID NO: 4772 - protein, 17 aa, Artificial Sequence
  Description of Artificial Sequence: Synthetic peptide
  XENP019464 vhCDR2
FISYDGNNKYYADSVKG

SEQ ID NO: 4773 - protein, 9 aa, Artificial Sequence
  Description of Artificial Sequence: Synthetic peptide
  XENP019464 vhCDR3
TGWLGPFDY

SEQ ID NO: 4774 - protein, 215 aa, Artificial Sequence
  Description of Artificial Sequence: Synthetic polypeptide
  XENP019464 [CTLA-4]_H0_L0.49_Fab Light Chain
EIVLTQSPGTLSLSPGERATLSCRASQSVGSSYLAWYRQKPGQAPELLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4775 - protein, 108 aa, Artificial Sequence; identical to SEQ ID NO: 1850
  Description of Artificial Sequence: Synthetic polypeptide
  VL of XENP019464

SEQ ID NO: 4776 - protein, 12 aa, Artificial Sequence
  Description of Artificial Sequence: Synthetic peptide
  XENP019464 vlCDR1
RASQSVGSSYLA

SEQ ID NO: 4777 - protein, 7 aa, Artificial Sequence
  Description of Artificial Sequence: Synthetic peptide
  XENP019464 vlCDR2
GAFSRAT

SEQ ID NO: 4778 - protein, 9 aa, Artificial Sequence
  Description of Artificial Sequence: Synthetic peptide
  XENP019464 vlCDR3
QQYGSSPWT

SEQ ID NO: 4779 - protein, 221 aa, Artificial Sequence; identical to SEQ ID NO: 2919
  Description of Artificial Sequence: Synthetic polypeptide
  XENP019465 [CTLA-4]_H0_L0.50_Fab Heavy Chain

SEQ ID NO: 4780 - protein, 118 aa, Artificial Sequence; identical to SEQ ID NO: 22
  Description of Artificial Sequence: Synthetic polypeptide
  VH of XENP019465

SEQ ID NO: 4781 - protein, 5 aa, Artificial Sequence
  Description of Artificial Sequence: Synthetic peptide
  XENP019465 vhCDR1
SYTMH

SEQ ID NO: 4782 - protein, 17 aa, Artificial Sequence
  Description of Artificial Sequence: Synthetic peptide
  XENP019465 vhCDR2
FISYDGNNKYYADSVKG

SEQ ID NO: 4783 - protein, 9 aa, Artificial Sequence
  Description of Artificial Sequence: Synthetic peptide
  XENP019465 vhCDR3
TGWLGPFDY

SEQ ID NO: 4784 - protein, 215 aa, Artificial Sequence
  Description of Artificial Sequence: Synthetic polypeptide
  XENP019465 [CTLA-4]_H0_L0.50_Fab Light Chain
EIVLTQSPGTLSLSPGERATLSCRASQSVGSSYLAWYQEKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4785 - protein, 108 aa, Artificial Sequence; identical to SEQ ID NO: 32
  Description of Artificial Sequence: Synthetic polypeptide
  VL of XENP019465

SEQ ID NO: 4786 - protein, 12 aa, Artificial Sequence
  Description of Artificial Sequence: Synthetic peptide
  XENP019465 vlCDR1
RASQSVGSSYLA

SEQ ID NO: 4787 - protein, 7 aa, Artificial Sequence
  Description of Artificial Sequence: Synthetic peptide
  XENP019465 vlCDR2
GAFSRAT

SEQ ID NO: 4788 - protein, 9 aa, Artificial Sequence
  Description of Artificial Sequence: Synthetic peptide
  XENP019465 vlCDR3
QQYGSSPWT

SEQ ID NO: 4789 - protein, 221 aa, Artificial Sequence; identical to SEQ ID NO: 2919
  Description of Artificial Sequence: Synthetic polypeptide
  XENP019466 [CTLA-4]_H0_L0.51_Fab Heavy Chain

SEQ ID NO: 4790 - protein, 118 aa, Artificial Sequence; identical to SEQ ID NO: 22
  Description of Artificial Sequence: Synthetic polypeptide
  VH of XENP019466

SEQ ID NO: 4791 - protein, 5 aa, Artificial Sequence
  Description of Artificial Sequence: Synthetic peptide
  XENP019466 vhCDR1
SYTMH

SEQ ID NO: 4792 - protein, 17 aa, Artificial Sequence
  Description of Artificial Sequence: Synthetic peptide
  XENP019466 vhCDR2
FISYDGNNKYYADSVKG

SEQ ID NO: 4793 - protein, 9 aa, Artificial Sequence
  Description of Artificial Sequence: Synthetic peptide
  XENP019466 vhCDR3
TGWLGPFDY

SEQ ID NO: 4794 - protein, 215 aa, Artificial Sequence
  Description of Artificial Sequence: Synthetic polypeptide
  XENP019466 [CTLA-4]_H0_L0.51_Fab Light Chain
EIVLTQSPGTLSLSPGERATLSCRASQSVGSSYLAWYQQKPDQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4795 - protein, 108 aa, Artificial Sequence; identical to SEQ ID NO: 41
  Description of Artificial Sequence: Synthetic polypeptide
  VL of XENP019466

SEQ ID NO: 4796 - protein, 12 aa, Artificial Sequence
  Description of Artificial Sequence: Synthetic peptide
  XENP019466 vlCDR1
RASQSVGSSYLA

SEQ ID NO: 4797 - protein, 7 aa, Artificial Sequence
  Description of Artificial Sequence: Synthetic peptide
  XENP019466 vlCDR2
GAFSRAT

SEQ ID NO: 4798 - protein, 9 aa, Artificial Sequence
  Description of Artificial Sequence: Synthetic peptide
  XENP019466 vlCDR3
QQYGSSPWT

SEQ ID NO: 4799 - protein, 221 aa, Artificial Sequence; identical to SEQ ID NO: 2919
  Description of Artificial Sequence: Synthetic polypeptide
  XENP019467 [CTLA-4]_H0_L0.52_Fab Heavy Chain

SEQ ID NO: 4800 - protein, 118 aa, Artificial Sequence; identical to SEQ ID NO: 22
  Description of Artificial Sequence: Synthetic polypeptide
  VH of XENP019467

SEQ ID NO: 4801 - protein, 5 aa, Artificial Sequence
  Description of Artificial Sequence: Synthetic peptide
  XENP019467 vhCDR1
SYTMH

SEQ ID NO: 4802 - protein, 17 aa, Artificial Sequence
  Description of Artificial Sequence: Synthetic peptide
  XENP019467 vhCDR2
FISYDGNNKYYADSVKG

SEQ ID NO: 4803 - protein, 9 aa, Artificial Sequence
  Description of Artificial Sequence: Synthetic peptide
  XENP019467 vhCDR3
TGWLGPFDY

SEQ ID NO: 4804 - protein, 215 aa, Artificial Sequence
  Description of Artificial Sequence: Synthetic polypeptide
  XENP019467 [CTLA-4]_H0_L0.52_Fab Light Chain
EIVLTQSPGTLSLSPGERATLSCRASQSVGSSYLAWYQQKPEQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4805 - protein, 108 aa, Artificial Sequence; identical to SEQ ID NO: 1877
  Description of Artificial Sequence: Synthetic polypeptide
  VL of XENP019467

SEQ ID NO: 4806 - protein, 12 aa, Artificial Sequence
  Description of Artificial Sequence: Synthetic peptide
  XENP019467 vlCDR1
RASQSVGSSYLA

SEQ ID NO: 4807 - protein, 7 aa, Artificial Sequence
  Description of Artificial Sequence: Synthetic peptide
  XENP019467 vlCDR2
GAFSRAT

SEQ ID NO: 4808 - protein, 9 aa, Artificial Sequence
  Description of Artificial Sequence: Synthetic peptide
  XENP019467 vlCDR3
QQYGSSPWT

SEQ ID NO: 4809 - protein, 221 aa, Artificial Sequence; identical to SEQ ID NO: 2919
  Description of Artificial Sequence: Synthetic polypeptide
  XENP019468 [CTLA-4]_H0_L0.53_Fab Heavy Chain

SEQ ID NO: 4810 - protein, 118 aa, Artificial Sequence; identical to SEQ ID NO: 22
  Description of Artificial Sequence: Synthetic polypeptide
  VH of XENP019468

SEQ ID NO: 4811 - protein, 5 aa, Artificial Sequence
  Description of Artificial Sequence: Synthetic peptide
  XENP019468 vhCDR1
SYTMH

SEQ ID NO: 4812 - protein, 17 aa, Artificial Sequence
  Description of Artificial Sequence: Synthetic peptide
  XENP019468 vhCDR2
FISYDGNNKYYADSVKG

SEQ ID NO: 4813 - protein, 9 aa, Artificial Sequence
  Description of Artificial Sequence: Synthetic peptide
  XENP019468 vhCDR3
TGWLGPFDY

SEQ ID NO: 4814 - protein, 215 aa, Artificial Sequence
  Description of Artificial Sequence: Synthetic polypeptide
  XENP019468 [CTLA-4]_H0_L0.53_Fab Light Chain
EIVLTQSPGTLSLSPGERATLSCRASQSVGSSYLAWYQQKPGEAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4815 - protein, 108 aa, Artificial Sequence; identical to SEQ ID NO: 77
  Description of Artificial Sequence: Synthetic polypeptide
  VL of XENP019468

SEQ ID NO: 4816 - protein, 12 aa, Artificial Sequence
  Description of Artificial Sequence: Synthetic peptide
  XENP019468 vlCDR1
RASQSVGSSYLA

SEQ ID NO: 4817 - protein, 7 aa, Artificial Sequence
  Description of Artificial Sequence: Synthetic peptide
  XENP019468 vlCDR2
GAFSRAT

SEQ ID NO: 4818 - protein, 9 aa, Artificial Sequence
  Description of Artificial Sequence: Synthetic peptide
  XENP019468 vlCDR3
QQYGSSPWT

SEQ ID NO: 4819 - protein, 221 aa, Artificial Sequence; identical to SEQ ID NO: 2919
  Description of Artificial Sequence: Synthetic polypeptide
  XENP019469 [CTLA-4]_H0_L0.54_Fab Heavy Chain

SEQ ID NO: 4820 - protein, 118 aa, Artificial Sequence; identical to SEQ ID NO: 22
  Description of Artificial Sequence: Synthetic polypeptide
  VH of XENP019469

SEQ ID NO: 4821 - protein, 5 aa, Artificial Sequence
  Description of Artificial Sequence: Synthetic peptide
  XENP019469 vhCDR1
SYTMH

SEQ ID NO: 4822 - protein, 17 aa, Artificial Sequence
  Description of Artificial Sequence: Synthetic peptide
  XENP019469 vhCDR2
FISYDGNNKYYADSVKG

SEQ ID NO: 4823 - protein, 9 aa, Artificial Sequence
  Description of Artificial Sequence: Synthetic peptide
  XENP019469 vhCDR3
TGWLGPFDY

SEQ ID NO: 4824 - protein, 215 aa, Artificial Sequence
  Description of Artificial Sequence: Synthetic polypeptide
  XENP019469 [CTLA-4]_H0_L0.54_Fab Light Chain
EIVLTQSPGTLSLSPGERATLSCRASQSVGSSYLAWYQQKPGKAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4825 - protein, 108 aa, Artificial Sequence; identical to SEQ ID NO: 1895
  Description of Artificial Sequence: Synthetic polypeptide
  VL of XENP019469

SEQ ID NO: 4826 - protein, 12 aa, Artificial Sequence
  Description of Artificial Sequence: Synthetic peptide
  XENP019469 vlCDR1
RASQSVGSSYLA

SEQ ID NO: 4827 - protein, 7 aa, Artificial Sequence
  Description of Artificial Sequence: Synthetic peptide
  XENP019469 vlCDR2
GAFSRAT

SEQ ID NO: 4828 - protein, 9 aa, Artificial Sequence
  Description of Artificial Sequence: Synthetic peptide
  XENP019469 vlCDR3
QQYGSSPWT

SEQ ID NO: 4829 - protein, 221 aa, Artificial Sequence; identical to SEQ ID NO: 2919
  Description of Artificial Sequence: Synthetic polypeptide
  XENP019470 [CTLA-4]_H0_L0.55_Fab Heavy Chain

SEQ ID NO: 4830 - protein, 118 aa, Artificial Sequence; identical to SEQ ID NO: 22
  Description of Artificial Sequence: Synthetic polypeptide
  VH of XENP019470

SEQ ID NO: 4831 - protein, 5 aa, Artificial Sequence
  Description of Artificial Sequence: Synthetic peptide
  XENP019470 vhCDR1
SYTMH

SEQ ID NO: 4832 - protein, 17 aa, Artificial Sequence
  Description of Artificial Sequence: Synthetic peptide
  XENP019470 vhCDR2
FISYDGNNKYYADSVKG

SEQ ID NO: 4833 - protein, 9 aa, Artificial Sequence
  Description of Artificial Sequence: Synthetic peptide
  XENP019470 vhCDR3
TGWLGPFDY

SEQ ID NO: 4834 - protein, 215 aa, Artificial Sequence
  Description of Artificial Sequence: Synthetic polypeptide
  XENP019470 [CTLA-4]_H0_L0.55_Fab Light Chain
EIVLTQSPGTLSLSPGERATLSCRASQSVGSSYLAWYQQKPGKSPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4835 - protein, 108 aa, Artificial Sequence; identical to SEQ ID NO: 1904
  Description of Artificial Sequence: Synthetic polypeptide
  VL of XENP019470

SEQ ID NO: 4836 - protein, 12 aa, Artificial Sequence
  Description of Artificial Sequence: Synthetic peptide
  XENP019470 vlCDR1
RASQSVGSSYLA

SEQ ID NO: 4837 - protein, 7 aa, Artificial Sequence
  Description of Artificial Sequence: Synthetic peptide
  XENP019470 vlCDR2
GAFSRAT

SEQ ID NO: 4838 - protein, 9 aa, Artificial Sequence
  Description of Artificial Sequence: Synthetic peptide
  XENP019470 vlCDR3
QQYGSSPWT

SEQ ID NO: 4839 - protein, 221 aa, Artificial Sequence; identical to SEQ ID NO: 2919
  Description of Artificial Sequence: Synthetic polypeptide
  XENP019471 [CTLA-4]_H0_L0.56_Fab Heavy Chain

SEQ ID NO: 4840 - protein, 118 aa, Artificial Sequence; identical to SEQ ID NO: 22
  Description of Artificial Sequence: Synthetic polypeptide
  VH of XENP019471

SEQ ID NO: 4841 - protein, 5 aa, Artificial Sequence
  Description of Artificial Sequence: Synthetic peptide
  XENP019471 vhCDR1
SYTMH

SEQ ID NO: 4842 - protein, 17 aa, Artificial Sequence
  Description of Artificial Sequence: Synthetic peptide
  XENP019471 vhCDR2
FISYDGNNKYYADSVKG

SEQ ID NO: 4843 - protein, 9 aa, Artificial Sequence
  Description of Artificial Sequence: Synthetic peptide
  XENP019471 vhCDR3
TGWLGPFDY

SEQ ID NO: 4844 - protein, 215 aa, Artificial Sequence
  Description of Artificial Sequence: Synthetic polypeptide
  XENP019471 [CTLA-4]_H0_L0.56_Fab Light Chain
EIVLTQSPGTLSLSPGERATLSCRASQSVGSSYLAWYQQKPGQSPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4845 - protein, 108 aa, Artificial Sequence; identical to SEQ ID NO: 1913
  Description of Artificial Sequence: Synthetic polypeptide
  VL of XENP019471

SEQ ID NO: 4846 - protein, 12 aa, Artificial Sequence
  Description of Artificial Sequence: Synthetic peptide
  XENP019471 vlCDR1
RASQSVGSSYLA

SEQ ID NO: 4847 - protein, 7 aa, Artificial Sequence
  Description of Artificial Sequence: Synthetic peptide
  XENP019471 vlCDR2
GAFSRAT

SEQ ID NO: 4848 - protein, 9 aa, Artificial Sequence
  Description of Artificial Sequence: Synthetic peptide
  XENP019471 vlCDR3
QQYGSSPWT

SEQ ID NO: 4849 - protein, 221 aa, Artificial Sequence; identical to SEQ ID NO: 2919
  Description of Artificial Sequence: Synthetic polypeptide
  XENP019472 [CTLA-4]_H0_L0.57_Fab Heavy Chain

SEQ ID NO: 4850 - protein, 118 aa, Artificial Sequence; identical to SEQ ID NO: 22
  Description of Artificial Sequence: Synthetic polypeptide
  VH of XENP019472

SEQ ID NO: 4851 - protein, 5 aa, Artificial Sequence
  Description of Artificial Sequence: Synthetic peptide
  XENP019472 vhCDR1
SYTMH

SEQ ID NO: 4852 - protein, 17 aa, Artificial Sequence
  Description of Artificial Sequence: Synthetic peptide
  XENP019472 vhCDR2
FISYDGNNKYYADSVKG

SEQ ID NO: 4853 - protein, 9 aa, Artificial Sequence
  Description of Artificial Sequence: Synthetic peptide
  XENP019472 vhCDR3
TGWLGPFDY

SEQ ID NO: 4854 - protein, 215 aa, Artificial Sequence
  Description of Artificial Sequence: Synthetic polypeptide
  XENP019472 [CTLA-4]_H0_L0.57_Fab Light Chain
EIVLTQSPGTLSLSPGERATLSCRASQSVGSSYLAWYQQKPGQAPELLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4855 - protein, 108 aa, Artificial Sequence; identical to SEQ ID NO: 86
  Description of Artificial Sequence: Synthetic polypeptide
  VL of XENP019472

SEQ ID NO: 4856 - protein, 12 aa, Artificial Sequence
  Description of Artificial Sequence: Synthetic peptide
  XENP019472 vlCDR1
RASQSVGSSYLA

SEQ ID NO: 4857 - protein, 7 aa, Artificial Sequence
  Description of Artificial Sequence: Synthetic peptide
  XENP019472 vlCDR2
GAFSRAT

SEQ ID NO: 4858 - protein, 9 aa, Artificial Sequence
  Description of Artificial Sequence: Synthetic peptide
  XENP019472 vlCDR3
QQYGSSPWT

SEQ ID NO: 4859 - protein, 221 aa, Artificial Sequence; identical to SEQ ID NO: 2919
  Description of Artificial Sequence: Synthetic polypeptide
  XENP019473 [CTLA-4]_H0_L0.58_Fab Heavy Chain

SEQ ID NO: 4860 - protein, 118 aa, Artificial Sequence; identical to SEQ ID NO: 22
  Description of Artificial Sequence: Synthetic polypeptide
  VH of XENP019473

SEQ ID NO: 4861 - protein, 5 aa, Artificial Sequence
  Description of Artificial Sequence: Synthetic peptide
  XENP019473 vhCDR1
SYTMH

SEQ ID NO: 4862 - protein, 17 aa, Artificial Sequence
  Description of Artificial Sequence: Synthetic peptide
  XENP019473 vhCDR2
FISYDGNNKYYADSVKG

SEQ ID NO: 4863 - protein, 9 aa, Artificial Sequence
  Description of Artificial Sequence: Synthetic peptide
  XENP019473 vhCDR3
TGWLGPFDY

SEQ ID NO: 4864 - protein, 215 aa, Artificial Sequence
  Description of Artificial Sequence: Synthetic polypeptide
  XENP019473 [CTLA-4]_H0_L0.58_Fab Light Chain
EIVLTQSPGTLSLSPGERATLSCRASQSVGSSYLAWYQQKPGQAPELLIYGAFSRATGIPDRFSGSGSGTDFTLTISRLEPQDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4865 - protein, 108 aa, Artificial Sequence; identical to SEQ ID NO: 1931
  Description of Artificial Sequence: Synthetic polypeptide
  VL of XENP019473

SEQ ID NO: 4866 - protein, 12 aa, Artificial Sequence
  Description of Artificial Sequence: Synthetic peptide
  XENP019473 vlCDR1
RASQSVGSSYLA

SEQ ID NO: 4867 - protein, 7 aa, Artificial Sequence
  Description of Artificial Sequence: Synthetic peptide
  XENP019473 vlCDR2
GAFSRAT

SEQ ID NO: 4868 - protein, 9 aa, Artificial Sequence
  Description of Artificial Sequence: Synthetic peptide
  XENP019473 vlCDR3
QQYGSSPWT

SEQ ID NO: 4869 - protein, 221 aa, Artificial Sequence; identical to SEQ ID NO: 2919
  Description of Artificial Sequence: Synthetic polypeptide
  XENP019474 [CTLA-4]_H0_L0.59_Fab Heavy Chain

SEQ ID NO: 4870 - protein, 118 aa, Artificial Sequence; identical to SEQ ID NO: 22
  Description of Artificial Sequence: Synthetic polypeptide
  VH of XENP019474

SEQ ID NO: 4871 - protein, 5 aa, Artificial Sequence
  Description of Artificial Sequence: Synthetic peptide
  XENP019474 vhCDR1
SYTMH

SEQ ID NO: 4872 - protein, 17 aa, Artificial Sequence
  Description of Artificial Sequence: Synthetic peptide
  XENP019474 vhCDR2
FISYDGNNKYYADSVKG

SEQ ID NO: 4873 - protein, 9 aa, Artificial Sequence
  Description of Artificial Sequence: Synthetic peptide
  XENP019474 vhCDR3
TGWLGPFDY

SEQ ID NO: 4874 - protein, 215 aa, Artificial Sequence
  Description of Artificial Sequence: Synthetic polypeptide
  XENP019474 [CTLA-4]_H0_L0.59_Fab Light Chain
EIVLTQSPGTLSLSPGERATLSCRASQSVGSSYLAWYQQKPGQAPKLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4875 - protein, 108 aa, Artificial Sequence; identical to SEQ ID NO: 1940
  Description of Artificial Sequence: Synthetic polypeptide
  VL of XENP019474

SEQ ID NO: 4876 - protein, 12 aa, Artificial Sequence
  Description of Artificial Sequence: Synthetic peptide
  XENP019474 vlCDR1
RASQSVGSSYLA

SEQ ID NO: 4877 - protein, 7 aa, Artificial Sequence
  Description of Artificial Sequence: Synthetic peptide
  XENP019474 vlCDR2
GAFSRAT

SEQ ID NO: 4878 - protein, 9 aa, Artificial Sequence
  Description of Artificial Sequence: Synthetic peptide
  XENP019474 vlCDR3
QQYGSSPWT

SEQ ID NO: 4879 - protein, 221 aa, Artificial Sequence; identical to SEQ ID NO: 2919
  Description of Artificial Sequence: Synthetic polypeptide
  XENP019475 [CTLA-4]_H0_L0.60_Fab Heavy Chain

SEQ ID NO: 4880 - protein, 118 aa, Artificial Sequence; identical to SEQ ID NO: 22
  Description of Artificial Sequence: Synthetic polypeptide
  VH of XENP019475

SEQ ID NO: 4881 - protein, 5 aa, Artificial Sequence
  Description of Artificial Sequence: Synthetic peptide
  XENP019475 vhCDR1
SYTMH

SEQ ID NO: 4882 - protein, 17 aa, Artificial Sequence
  Description of Artificial Sequence: Synthetic peptide
  XENP019475 vhCDR2
FISYDGNNKYYADSVKG

SEQ ID NO: 4883 - protein, 9 aa, Artificial Sequence
  Description of Artificial Sequence: Synthetic peptide
  XENP019475 vhCDR3
TGWLGPFDY

SEQ ID NO: 4884 - protein, 215 aa, Artificial Sequence
  Description of Artificial Sequence: Synthetic polypeptide
  XENP019475 [CTLA-4]_H0_L0.60_Fab Light Chain
EIVLTQSPGTLSLSPGERATLSCRASQSVGSSYLAWYQQKPGQAPRRLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4885 - protein, 108 aa, Artificial Sequence; identical to SEQ ID NO: 1949
  Description of Artificial Sequence: Synthetic polypeptide
  VL of XENP019475

SEQ ID NO: 4886 - protein, 12 aa, Artificial Sequence
  Description of Artificial Sequence: Synthetic peptide
  XENP019475 vlCDR1
RASQSVGSSYLA

SEQ ID NO: 4887 - protein, 7 aa, Artificial Sequence
  Description of Artificial Sequence: Synthetic peptide
  XENP019475 vlCDR2
GAFSRAT

SEQ ID NO: 4888 - protein, 9 aa, Artificial Sequence
  Description of Artificial Sequence: Synthetic peptide
  XENP019475 vlCDR3
QQYGSSPWT

SEQ ID NO: 4889 - protein, 221 aa, Artificial Sequence; identical to SEQ ID NO: 2919
  Description of Artificial Sequence: Synthetic polypeptide
  XENP019476 [CTLA-4]_H0_L0.61_Fab Heavy Chain

SEQ ID NO: 4890 - protein, 118 aa, Artificial Sequence; identical to SEQ ID NO: 22
  Description of Artificial Sequence: Synthetic polypeptide
  VH of XENP019476

SEQ ID NO: 4891 - protein, 5 aa, Artificial Sequence
  Description of Artificial Sequence: Synthetic peptide
  XENP019476 vhCDR1
SYTMH

SEQ ID NO: 4892 - protein, 17 aa, Artificial Sequence
  Description of Artificial Sequence: Synthetic peptide
  XENP019476 vhCDR2
FISYDGNNKYYADSVKG

SEQ ID NO: 4893 - protein, 9 aa, Artificial Sequence
  Description of Artificial Sequence: Synthetic peptide
  XENP019476 vhCDR3
TGWLGPFDY

SEQ ID NO: 4894 - protein, 215 aa, Artificial Sequence
  Description of Artificial Sequence: Synthetic polypeptide
  XENP019476 [CTLA-4]_H0_L0.61_Fab Light Chain
EIVLTQSPGTLSLSPGERATLSCRASQSVGSSYLAWYQQKPGQAPRRLIYGAFSRDTGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4895 - protein, 108 aa, Artificial Sequence; identical to SEQ ID NO: 1958
  Description of Artificial Sequence: Synthetic polypeptide
  VL of XENP019476

SEQ ID NO: 4896 - protein, 12 aa, Artificial Sequence
  Description of Artificial Sequence: Synthetic peptide
  XENP019476 vlCDR1
RASQSVGSSYLA

SEQ ID NO: 4897 - protein, 7 aa, Artificial Sequence
  Description of Artificial Sequence: Synthetic peptide
  XENP019476 vlCDR2
GAFSRDT

SEQ ID NO: 4898 - protein, 9 aa, Artificial Sequence
  Description of Artificial Sequence: Synthetic peptide
  XENP019476 vlCDR3
QQYGSSPWT

SEQ ID NO: 4899 - protein, 221 aa, Artificial Sequence; identical to SEQ ID NO: 2919
  Description of Artificial Sequence: Synthetic polypeptide
  XENP019477 [CTLA-4]_H0_L0.62_Fab Heavy Chain

SEQ ID NO: 4900 - protein, 118 aa, Artificial Sequence; identical to SEQ ID NO: 22
  Description of Artificial Sequence: Synthetic polypeptide
  VH of XENP019477

SEQ ID NO: 4901 - protein, 5 aa, Artificial Sequence
  Description of Artificial Sequence: Synthetic peptide
  XENP019477 vhCDR1
SYTMH

SEQ ID NO: 4902 - protein, 17 aa, Artificial Sequence
  Description of Artificial Sequence: Synthetic peptide
  XENP019477 vhCDR2
FISYDGNNKYYADSVKG

SEQ ID NO: 4903 - protein, 9 aa, Artificial Sequence
  Description of Artificial Sequence: Synthetic peptide
  XENP019477 vhCDR3
TGWLGPFDY

SEQ ID NO: 4904 - protein, 215 aa, Artificial Sequence
  Description of Artificial Sequence: Synthetic polypeptide
  XENP019477 [CTLA-4]_H0_L0.62_Fab Light Chain
EIVLTQSPGTLSLSPGERATLSCRASQSVGSSYLAWYQQKPGQAPRLLIAGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4905 - protein, 108 aa, Artificial Sequence; identical to SEQ ID NO: 1967
  Description of Artificial Sequence: Synthetic polypeptide
  VL of XENP019477

SEQ ID NO: 4906 - protein, 12 aa, Artificial Sequence
  Description of Artificial Sequence: Synthetic peptide
  XENP019477 vlCDR1
RASQSVGSSYLA

SEQ ID NO: 4907 - protein, 7 aa, Artificial Sequence
  Description of Artificial Sequence: Synthetic peptide
  XENP019477 vlCDR2
GAFSRAT

SEQ ID NO: 4908 - protein, 9 aa, Artificial Sequence
  Description of Artificial Sequence: Synthetic peptide
  XENP019477 vlCDR3
QQYGSSPWT

SEQ ID NO: 4909 - protein, 221 aa, Artificial Sequence; identical to SEQ ID NO: 2919
  Description of Artificial Sequence: Synthetic polypeptide
  XENP019478 [CTLA-4]_H0_L0.63_Fab Heavy Chain

SEQ ID NO: 4910 - protein, 118 aa, Artificial Sequence; identical to SEQ ID NO: 22
  Description of Artificial Sequence: Synthetic polypeptide
  VH of XENP019478

SEQ ID NO: 4911 - protein, 5 aa, Artificial Sequence
  Description of Artificial Sequence: Synthetic peptide
  XENP019478 vhCDR1
SYTMH

SEQ ID NO: 4912 - protein, 17 aa, Artificial Sequence
  Description of Artificial Sequence: Synthetic peptide
  XENP019478 vhCDR2
FISYDGNNKYYADSVKG

SEQ ID NO: 4913 - protein, 9 aa, Artificial Sequence
  Description of Artificial Sequence: Synthetic peptide
  XENP019478 vhCDR3
TGWLGPFDY

SEQ ID NO: 4914 - protein, 215 aa, Artificial Sequence
  Description of Artificial Sequence: Synthetic polypeptide
  XENP019478 [CTLA-4]_H0_L0.63_Fab Light Chain
EIVLTQSPGTLSLSPGERATLSCRASQSVGSSYLAWYQQKPGQAPRLLIFGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4915 - protein, 108 aa, Artificial Sequence; identical to SEQ ID NO: 1976
  Description of Artificial Sequence: Synthetic polypeptide
  VL of XENP019478

SEQ ID NO: 4916 - protein, 12 aa, Artificial Sequence
  Description of Artificial Sequence: Synthetic peptide
  XENP019478 vlCDR1
RASQSVGSSYLA

SEQ ID NO: 4917 - protein, 7 aa, Artificial Sequence
  Description of Artificial Sequence: Synthetic peptide
  XENP019478 vlCDR2
GAFSRAT

SEQ ID NO: 4918 - protein, 9 aa, Artificial Sequence
  Description of Artificial Sequence: Synthetic peptide
  XENP019478 vlCDR3
QQYGSSPWT

SEQ ID NO: 4919 - protein, 221 aa, Artificial Sequence; identical to SEQ ID NO: 2919
  Description of Artificial Sequence: Synthetic polypeptide
  XENP019479 [CTLA-4]_H0_L0.64_Fab Heavy Chain

SEQ ID NO: 4920 - protein, 118 aa, Artificial Sequence; identical to SEQ ID NO: 22
  Description of Artificial Sequence: Synthetic polypeptide
  VH of XENP019479

SEQ ID NO: 4921 - protein, 5 aa, Artificial Sequence
  Description of Artificial Sequence: Synthetic peptide
  XENP019479 vhCDR1
SYTMH

SEQ ID NO: 4922 - protein, 17 aa, Artificial Sequence
  Description of Artificial Sequence: Synthetic peptide
  XENP019479 vhCDR2
FISYDGNNKYYADSVKG

SEQ ID NO: 4923 - protein, 9 aa, Artificial Sequence
  Description of Artificial Sequence: Synthetic peptide
  XENP019479 vhCDR3
TGWLGPFDY

SEQ ID NO: 4924 - protein, 215 aa, Artificial Sequence
  Description of Artificial Sequence: Synthetic polypeptide
  XENP019479 [CTLA-4]_H0_L0.64_Fab Light Chain
EIVLTQSPGTLSLSPGERATLSCRASQSVGSSYLAWYQQKPGQAPRLLIHGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4925 - protein, 108 aa, Artificial Sequence; identical to SEQ ID NO: 1985
  Description of Artificial Sequence: Synthetic polypeptide
  VL of XENP019479

SEQ ID NO: 4926 - protein, 12 aa, Artificial Sequence
  Description of Artificial Sequence: Synthetic peptide
  XENP019479 vlCDR1
RASQSVGSSYLA

SEQ ID NO: 4927 - protein, 7 aa, Artificial Sequence
  Description of Artificial Sequence: Synthetic peptide
  XENP019479 vlCDR2
GAFSRAT

SEQ ID NO: 4928 - protein, 9 aa, Artificial Sequence
  Description of Artificial Sequence: Synthetic peptide
  XENP019479 vlCDR3
QQYGSSPWT

SEQ ID NO: 4929 - protein, 221 aa, Artificial Sequence; identical to SEQ ID NO: 2919
  Description of Artificial Sequence: Synthetic polypeptide
  XENP019480 [CTLA-4]_H0_L0.65_Fab Heavy Chain

SEQ ID NO: 4930 - protein, 118 aa, Artificial Sequence; identical to SEQ ID NO: 22
  Description of Artificial Sequence: Synthetic polypeptide
  VH of XENP019480

SEQ ID NO: 4931 - protein, 5 aa, Artificial Sequence
  Description of Artificial Sequence: Synthetic peptide
  XENP019480 vhCDR1
SYTMH

SEQ ID NO: 4932 - protein, 17 aa, Artificial Sequence
  Description of Artificial Sequence: Synthetic peptide
  XENP019480 vhCDR2
FISYDGNNKYYADSVKG

SEQ ID NO: 4933 - protein, 9 aa, Artificial Sequence
  Description of Artificial Sequence: Synthetic peptide
  XENP019480 vhCDR3
TGWLGPFDY

SEQ ID NO: 4934 - protein, 215 aa, Artificial Sequence
  Description of Artificial Sequence: Synthetic polypeptide
  XENP019480 [CTLA-4]_H0_L0.65_Fab Light Chain
EIVLTQSPGTLSLSPGERATLSCRASQSVGSSYLAWYQQKPGQAPRLLILGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4935 - protein, 108 aa, Artificial Sequence; identical to SEQ ID NO: 1994
  Description of Artificial Sequence: Synthetic polypeptide
  VL of XENP019480

SEQ ID NO: 4936 - protein, 12 aa, Artificial Sequence
  Description of Artificial Sequence: Synthetic peptide
  XENP019480 vlCDR1
RASQSVGSSYLA

SEQ ID NO: 4937 - protein, 7 aa, Artificial Sequence
  Description of Artificial Sequence: Synthetic peptide
  XENP019480 vlCDR2
GAFSRAT

SEQ ID NO: 4938 - protein, 9 aa, Artificial Sequence
  Description of Artificial Sequence: Synthetic peptide
  XENP019480 vlCDR3
QQYGSSPWT

SEQ ID NO: 4939 - protein, 221 aa, Artificial Sequence; identical to SEQ ID NO: 2919
  Description of Artificial Sequence: Synthetic polypeptide
  XENP019481 [CTLA-4]_H0_L0.66_Fab Heavy Chain

SEQ ID NO: 4940 - protein, 118 aa, Artificial Sequence; identical to SEQ ID NO: 22
  Description of Artificial Sequence: Synthetic polypeptide
  VH of XENP019481

SEQ ID NO: 4941 - protein, 5 aa, Artificial Sequence
  Description of Artificial Sequence: Synthetic peptide
  XENP019481 vhCDR1
SYTMH

SEQ ID NO: 4942 - protein, 17 aa, Artificial Sequence
  Description of Artificial Sequence: Synthetic peptide
  XENP019481 vhCDR2
FISYDGNNKYYADSVKG

SEQ ID NO: 4943 - protein, 9 aa, Artificial Sequence
  Description of Artificial Sequence: Synthetic peptide
  XENP019481 vhCDR3
TGWLGPFDY

SEQ ID NO: 4944 - protein, 215 aa, Artificial Sequence
  Description of Artificial Sequence: Synthetic polypeptide
  XENP019481 [CTLA-4]_H0_L0.66_Fab Light Chain
EIVLTQSPGTLSLSPGERATLSCRASQSVGSSYLAWYQQKPGQAPRLLIVGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4945 - protein, 108 aa, Artificial Sequence; identical to SEQ ID NO: 2003
  Description of Artificial Sequence: Synthetic polypeptide
  VL of XENP019481

SEQ ID NO: 4946 - protein, 12 aa, Artificial Sequence
  Description of Artificial Sequence: Synthetic peptide
  XENP019481 vlCDR1
RASQSVGSSYLA

SEQ ID NO: 4947 - protein, 7 aa, Artificial Sequence
  Description of Artificial Sequence: Synthetic peptide
  XENP019481 vlCDR2
GAFSRAT

SEQ ID NO: 4948 - protein, 9 aa, Artificial Sequence
  Description of Artificial Sequence: Synthetic peptide
  XENP019481 vlCDR3
QQYGSSPWT

SEQ ID NO: 4949 - protein, 221 aa, Artificial Sequence; identical to SEQ ID NO: 2919
  Description of Artificial Sequence: Synthetic polypeptide
  XENP019482 [CTLA-4]_H0_L0.67_Fab Heavy Chain

SEQ ID NO: 4950 - protein, 118 aa, Artificial Sequence; identical to SEQ ID NO: 22
  Description of Artificial Sequence: Synthetic polypeptide
  VH of XENP019482

SEQ ID NO: 4951 - protein, 5 aa, Artificial Sequence
  Description of Artificial Sequence: Synthetic peptide
  XENP019482 vhCDR1
SYTMH

SEQ ID NO: 4952 - protein, 17 aa, Artificial Sequence
  Description of Artificial Sequence: Synthetic peptide
  XENP019482 vhCDR2
FISYDGNNKYYADSVKG

SEQ ID NO: 4953 - protein, 9 aa, Artificial Sequence
  Description of Artificial Sequence: Synthetic peptide
  XENP019482 vhCDR3
TGWLGPFDY

SEQ ID NO: 4954 - protein, 215 aa, Artificial Sequence
  Description of Artificial Sequence: Synthetic polypeptide
  XENP019482 [CTLA-4]_H0_L0.67_Fab Light Chain
EIVLTQSPGTLSLSPGERATLSCRASQSVGSSYLAWYQQKPGQAPRLLIYDAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4955 - protein, 108 aa, Artificial Sequence; identical to SEQ ID NO: 2012
  Description of Artificial Sequence: Synthetic polypeptide
  VL of XENP019482

SEQ ID NO: 4956 - protein, 12 aa, Artificial Sequence
  Description of Artificial Sequence: Synthetic peptide
  XENP019482 vlCDR1
RASQSVGSSYLA

SEQ ID NO: 4957 - protein, 7 aa, Artificial Sequence
  Description of Artificial Sequence: Synthetic peptide
  XENP019482 vlCDR2
DAFSRAT

SEQ ID NO: 4958 - protein, 9 aa, Artificial Sequence
  Description of Artificial Sequence: Synthetic peptide
  XENP019482 vlCDR3
QQYGSSPWT

SEQ ID NO: 4959 - protein, 221 aa, Artificial Sequence; identical to SEQ ID NO: 2919
  Description of Artificial Sequence: Synthetic polypeptide
  XENP019483 [CTLA-4]_H0_L0.68_Fab Heavy Chain

SEQ ID NO: 4960 - protein, 118 aa, Artificial Sequence; identical to SEQ ID NO: 22
  Description of Artificial Sequence: Synthetic polypeptide
  VH of XENP019483

SEQ ID NO: 4961 - protein, 5 aa, Artificial Sequence
  Description of Artificial Sequence: Synthetic peptide
  XENP019483 vhCDR1
SYTMH

SEQ ID NO: 4962 - protein, 17 aa, Artificial Sequence
  Description of Artificial Sequence: Synthetic peptide
  XENP019483 vhCDR2
FISYDGNNKYYADSVKG

SEQ ID NO: 4963 - protein, 9 aa, Artificial Sequence
  Description of Artificial Sequence: Synthetic peptide
  XENP019483 vhCDR3
TGWLGPFDY

SEQ ID NO: 4964 - protein, 215 aa, Artificial Sequence
  Description of Artificial Sequence: Synthetic polypeptide
  XENP019483 [CTLA-4]_H0_L0.68_Fab Light Chain
EIVLTQSPGTLSLSPGERATLSCRASQSVGSSYLAWYQQKPGQAPRLLIYSAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4965 - protein, 108 aa, Artificial Sequence; identical to SEQ ID NO: 2021
  Description of Artificial Sequence: Synthetic polypeptide
  VL of XENP019483

SEQ ID NO: 4966 - protein, 12 aa, Artificial Sequence
  Description of Artificial Sequence: Synthetic peptide
  XENP019483 vlCDR1
RASQSVGSSYLA

SEQ ID NO: 4967 - protein, 7 aa, Artificial Sequence
  Description of Artificial Sequence: Synthetic peptide
  XENP019483 vlCDR2
SAFSRAT

SEQ ID NO: 4968 - protein, 9 aa, Artificial Sequence
  Description of Artificial Sequence: Synthetic peptide
  XENP019483 vlCDR3
QQYGSSPWT

SEQ ID NO: 4969 - protein, 221 aa, Artificial Sequence; identical to SEQ ID NO: 2919
  Description of Artificial Sequence: Synthetic polypeptide
  XENP019484 [CTLA-4]_H0_L0.69_Fab Heavy Chain

SEQ ID NO: 4970 - protein, 118 aa, Artificial Sequence; identical to SEQ ID NO: 22
  Description of Artificial Sequence: Synthetic polypeptide
  VH of XENP019484

SEQ ID NO: 4971 - protein, 5 aa, Artificial Sequence
  Description of Artificial Sequence: Synthetic peptide
  XENP019484 vhCDR1
SYTMH

SEQ ID NO: 4972 - protein, 17 aa, Artificial Sequence
  Description of Artificial Sequence: Synthetic peptide
  XENP019484 vhCDR2
FISYDGNNKYYADSVKG

SEQ ID NO: 4973 - protein, 9 aa, Artificial Sequence
  Description of Artificial Sequence: Synthetic peptide
  XENP019484 vhCDR3
TGWLGPFDY

SEQ ID NO: 4974 - protein, 215 aa, Artificial Sequence
  Description of Artificial Sequence: Synthetic polypeptide
  XENP019484 [CTLA-4]_H0_L0.69_Fab Light Chain
EIVLTQSPGTLSLSPGERATLSCRASQSVGSSYLAWYQQKPGQAPRLLIYGVFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4975 - protein, 108 aa, Artificial Sequence; identical to SEQ ID NO: 2030
  Description of Artificial Sequence: Synthetic polypeptide
  VL of XENP019484

SEQ ID NO: 4976 - protein, 12 aa, Artificial Sequence
  Description of Artificial Sequence: Synthetic peptide
  XENP019484 vlCDR1
RASQSVGSSYLA

SEQ ID NO: 4977 - protein, 7 aa, Artificial Sequence
  Description of Artificial Sequence: Synthetic peptide
  XENP019484 vlCDR2
GVFSRAT

SEQ ID NO: 4978 - protein, 9 aa, Artificial Sequence
  Description of Artificial Sequence: Synthetic peptide
  XENP019484 vlCDR3
QQYGSSPWT

SEQ ID NO: 4979 - protein, 221 aa, Artificial Sequence; identical to SEQ ID NO: 2919
  Description of Artificial Sequence: Synthetic polypeptide
  XENP019485 [CTLA-4]_H0_L0.70_Fab Heavy Chain

SEQ ID NO: 4980 - protein, 118 aa, Artificial Sequence; identical to SEQ ID NO: 22
  Description of Artificial Sequence: Synthetic polypeptide
  VH of XENP019485

SEQ ID NO: 4981 - protein, 5 aa, Artificial Sequence
  Description of Artificial Sequence: Synthetic peptide
  XENP019485 vhCDR1
SYTMH

SEQ ID NO: 4982 - protein, 17 aa, Artificial Sequence
  Description of Artificial Sequence: Synthetic peptide
  XENP019485 vhCDR2
FISYDGNNKYYADSVKG

SEQ ID NO: 4983 - protein, 9 aa, Artificial Sequence
  Description of Artificial Sequence: Synthetic peptide
  XENP019485 vhCDR3
TGWLGPFDY

SEQ ID NO: 4984 - protein, 215 aa, Artificial Sequence
  Description of Artificial Sequence: Synthetic polypeptide
  XENP019485 [CTLA-4]_H0_L0.70_Fab Light Chain
EIVLTQSPGTLSLSPGERATLSCRASQSVGSSYLAWYQQKPGQAPRLLIYGAHSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4985 - protein, 108 aa, Artificial Sequence; identical to SEQ ID NO: 2039
  Description of Artificial Sequence: Synthetic polypeptide
  VL of XENP019485

SEQ ID NO: 4986 - protein, 12 aa, Artificial Sequence
  Description of Artificial Sequence: Synthetic peptide
  XENP019485 vlCDR1
RASQSVGSSYLA

SEQ ID NO: 4987 - protein, 7 aa, Artificial Sequence
  Description of Artificial Sequence: Synthetic peptide
  XENP019485 vlCDR2
GAHSRAT

SEQ ID NO: 4988 - protein, 9 aa, Artificial Sequence
  Description of Artificial Sequence: Synthetic peptide
  XENP019485 vlCDR3
QQYGSSPWT

SEQ ID NO: 4989 - protein, 221 aa, Artificial Sequence; identical to SEQ ID NO: 2919
  Description of Artificial Sequence: Synthetic polypeptide
  XENP019486 [CTLA-4]_H0_L0.71_Fab Heavy Chain

SEQ ID NO: 4990 - protein, 118 aa, Artificial Sequence; identical to SEQ ID NO: 22
  Description of Artificial Sequence: Synthetic polypeptide
  VH of XENP019486

SEQ ID NO: 4991 - protein, 5 aa, Artificial Sequence
  Description of Artificial Sequence: Synthetic peptide
  XENP019486 vhCDR1
SYTMH

SEQ ID NO: 4992 - protein, 17 aa, Artificial Sequence
  Description of Artificial Sequence: Synthetic peptide
  XENP019486 vhCDR2
FISYDGNNKYYADSVKG

SEQ ID NO: 4993 - protein, 9 aa, Artificial Sequence
  Description of Artificial Sequence: Synthetic peptide
  XENP019486 vhCDR3
TGWLGPFDY

SEQ ID NO: 4994 - protein, 215 aa, Artificial Sequence
  Description of Artificial Sequence: Synthetic polypeptide
  XENP019486 [CTLA-4]_H0_L0.71_Fab Light Chain
EIVLTQSPGTLSLSPGERATLSCRASQSVGSSYLAWYQQKPGQAPRLLIYGAISRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4995 - protein, 108 aa, Artificial Sequence; identical to SEQ ID NO: 2048
  Description of Artificial Sequence: Synthetic polypeptide
  VL of XENP019486

SEQ ID NO: 4996 - protein, 12 aa, Artificial Sequence
  Description of Artificial Sequence: Synthetic peptide
  XENP019486 vlCDR1
RASQSVGSSYLA

SEQ ID NO: 4997 - protein, 7 aa, Artificial Sequence
  Description of Artificial Sequence: Synthetic peptide
  XENP019486 vlCDR2
GAISRAT

SEQ ID NO: 4998 - protein, 9 aa, Artificial Sequence
  Description of Artificial Sequence: Synthetic peptide
  XENP019486 vlCDR3
QQYGSSPWT

SEQ ID NO: 4999 - protein, 221 aa, Artificial Sequence; identical to SEQ ID NO: 2919
  Description of Artificial Sequence: Synthetic polypeptide
  XENP019487 [CTLA-4]_H0_L0.72_Fab Heavy Chain

SEQ ID NO: 5000 - protein, 118 aa, Artificial Sequence; identical to SEQ ID NO: 22
  Description of Artificial Sequence: Synthetic polypeptide
  VH of XENP019487

SEQ ID NO: 5001 - protein, 5 aa, Artificial Sequence
  Description of Artificial Sequence: Synthetic peptide
  XENP019487 vhCDR1
SYTMH

SEQ ID NO: 5002 - protein, 17 aa, Artificial Sequence
  Description of Artificial Sequence: Synthetic peptide
  XENP019487 vhCDR2
FISYDGNNKYYADSVKG

SEQ ID NO: 5003 - protein, 9 aa, Artificial Sequence
  Description of Artificial Sequence: Synthetic peptide
  XENP019487 vhCDR3
TGWLGPFDY

SEQ ID NO: 5004 - protein, 215 aa, Artificial Sequence
  Description of Artificial Sequence: Synthetic polypeptide
  XENP019487 [CTLA-4]_H0_L0.72_Fab Light Chain
EIVLTQSPGTLSLSPGERATLSCRASQSVGSSYLAWYQQKPGQAPRLLIYGALSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5005 - protein, 108 aa, Artificial Sequence; identical to SEQ ID NO: 2057
  Description of Artificial Sequence: Synthetic polypeptide
  VL of XENP019487

SEQ ID NO: 5006 - protein, 12 aa, Artificial Sequence
  Description of Artificial Sequence: Synthetic peptide
  XENP019487 vlCDR1
RASQSVGSSYLA

SEQ ID NO: 5007 - protein, 7 aa, Artificial Sequence
  Description of Artificial Sequence: Synthetic peptide
  XENP019487 vlCDR2
GALSRAT

SEQ ID NO: 5008 - protein, 9 aa, Artificial Sequence
  Description of Artificial Sequence: Synthetic peptide
  XENP019487 vlCDR3
QQYGSSPWT

SEQ ID NO: 5009 - protein, 221 aa, Artificial Sequence; identical to SEQ ID NO: 2919
  Description of Artificial Sequence: Synthetic polypeptide
  XENP019488 [CTLA-4]_H0_L0.73_Fab Heavy Chain

SEQ ID NO: 5010 - protein, 118 aa, Artificial Sequence; identical to SEQ ID NO: 22
  Description of Artificial Sequence: Synthetic polypeptide
  VH of XENP019488

SEQ ID NO: 5011 - protein, 5 aa, Artificial Sequence
  Description of Artificial Sequence: Synthetic peptide
  XENP019488 vhCDR1
SYTMH

SEQ ID NO: 5012 - protein, 17 aa, Artificial Sequence
  Description of Artificial Sequence: Synthetic peptide
  XENP019488 vhCDR2
FISYDGNNKYYADSVKG

SEQ ID NO: 5013 - protein, 9 aa, Artificial Sequence
  Description of Artificial Sequence: Synthetic peptide
  XENP019488 vhCDR3
TGWLGPFDY

SEQ ID NO: 5014 - protein, 215 aa, Artificial Sequence
  Description of Artificial Sequence: Synthetic polypeptide
  XENP019488 [CTLA-4]_H0_L0.73_Fab Light Chain
EIVLTQSPGTLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5015 - protein, 108 aa, Artificial Sequence; identical to SEQ ID NO: 2066
  Description of Artificial Sequence: Synthetic polypeptide
  VL of XENP019488

SEQ ID NO: 5016 - protein, 12 aa, Artificial Sequence
  Description of Artificial Sequence: Synthetic peptide
  XENP019488 vlCDR1
RASQSVGSSYLA

SEQ ID NO: 5017 - protein, 7 aa, Artificial Sequence
  Description of Artificial Sequence: Synthetic peptide
  XENP019488 vlCDR2
GASSRAT

SEQ ID NO: 5018 - protein, 9 aa, Artificial Sequence
  Description of Artificial Sequence: Synthetic peptide
  XENP019488 vlCDR3
QQYGSSPWT

SEQ ID NO: 5019 - protein, 221 aa, Artificial Sequence; identical to SEQ ID NO: 2919
  Description of Artificial Sequence: Synthetic polypeptide
  XENP019489 [CTLA-4]_H0_L0.74_Fab Heavy Chain

SEQ ID NO: 5020 - protein, 118 aa, Artificial Sequence; identical to SEQ ID NO: 22
  Description of Artificial Sequence: Synthetic polypeptide
  VH of XENP019489

SEQ ID NO: 5021 - protein, 5 aa, Artificial Sequence
  Description of Artificial Sequence: Synthetic peptide
  XENP019489 vhCDR1
SYTMH

SEQ ID NO: 5022 - protein, 17 aa, Artificial Sequence
  Description of Artificial Sequence: Synthetic peptide
  XENP019489 vhCDR2
FISYDGNNKYYADSVKG

SEQ ID NO: 5023 - protein, 9 aa, Artificial Sequence
  Description of Artificial Sequence: Synthetic peptide
  XENP019489 vhCDR3
TGWLGPFDY

SEQ ID NO: 5024 - protein, 215 aa, Artificial Sequence
  Description of Artificial Sequence: Synthetic polypeptide
  XENP019489 [CTLA-4]_H0_L0.74_Fab Light Chain
EIVLTQSPGTLSLSPGERATLSCRASQSVGSSYLAWYQQKPGQAPRLLIYGAYSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5025 - protein, 108 aa, Artificial Sequence; identical to SEQ ID NO: 2075
  Description of Artificial Sequence: Synthetic polypeptide
  VL of XENP019489

SEQ ID NO: 5026 - protein, 12 aa, Artificial Sequence
  Description of Artificial Sequence: Synthetic peptide
  XENP019489 vlCDR1
RASQSVGSSYLA

SEQ ID NO: 5027 - protein, 7 aa, Artificial Sequence
  Description of Artificial Sequence: Synthetic peptide
  XENP019489 vlCDR2
GAYSRAT

SEQ ID NO: 5028 - protein, 9 aa, Artificial Sequence
  Description of Artificial Sequence: Synthetic peptide
  XENP019489 vlCDR3
QQYGSSPWT

SEQ ID NO: 5029 - protein, 221 aa, Artificial Sequence; identical to SEQ ID NO: 2919
  Description of Artificial Sequence: Synthetic polypeptide
  XENP019490 [CTLA-4]_H0_L0.75_Fab Heavy Chain

SEQ ID NO: 5030 - protein, 118 aa, Artificial Sequence; identical to SEQ ID NO: 22
  Description of Artificial Sequence: Synthetic polypeptide
  VH of XENP019490

SEQ ID NO: 5031 - protein, 5 aa, Artificial Sequence
  Description of Artificial Sequence: Synthetic peptide
  XENP019490 vhCDR1
SYTMH

SEQ ID NO: 5032 - protein, 17 aa, Artificial Sequence
  Description of Artificial Sequence: Synthetic peptide
  XENP019490 vhCDR2
FISYDGNNKYYADSVKG

SEQ ID NO: 5033 - protein, 9 aa, Artificial Sequence
  Description of Artificial Sequence: Synthetic peptide
  XENP019490 vhCDR3
TGWLGPFDY

SEQ ID NO: 5034 - protein, 215 aa, Artificial Sequence
  Description of Artificial Sequence: Synthetic polypeptide
  XENP019490 [CTLA-4]_H0_L0.75_Fab Light Chain
EIVLTQSPGTLSLSPGERATLSCRASQSVGSSYLAWYQQKPGQAPRLLIYGAFARATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5035 - protein, 108 aa, Artificial Sequence; identical to SEQ ID NO: 2084
  Description of Artificial Sequence: Synthetic polypeptide
  VL of XENP019490

SEQ ID NO: 5036 - protein, 12 aa, Artificial Sequence
  Description of Artificial Sequence: Synthetic peptide
  XENP019490 vlCDR1
RASQSVGSSYLA

SEQ ID NO: 5037 - protein, 7 aa, Artificial Sequence
  Description of Artificial Sequence: Synthetic peptide
  XENP019490 vlCDR2
GAFARAT

SEQ ID NO: 5038 - protein, 9 aa, Artificial Sequence
  Description of Artificial Sequence: Synthetic peptide
  XENP019490 vlCDR3
QQYGSSPWT

SEQ ID NO: 5039 - protein, 221 aa, Artificial Sequence; identical to SEQ ID NO: 2919
  Description of Artificial Sequence: Synthetic polypeptide
  XENP019491 [CTLA-4]_H0_L0.76_Fab Heavy Chain

SEQ ID NO: 5040 - protein, 118 aa, Artificial Sequence; identical to SEQ ID NO: 22
  Description of Artificial Sequence: Synthetic polypeptide
  VH of XENP019491

SEQ ID NO: 5041 - protein, 5 aa, Artificial Sequence
  Description of Artificial Sequence: Synthetic peptide
  XENP019491 vhCDR1
SYTMH

SEQ ID NO: 5042 - protein, 17 aa, Artificial Sequence
  Description of Artificial Sequence: Synthetic peptide
  XENP019491 vhCDR2
FISYDGNNKYYADSVKG

SEQ ID NO: 5043 - protein, 9 aa, Artificial Sequence
  Description of Artificial Sequence: Synthetic peptide
  XENP019491 vhCDR3
TGWLGPFDY

SEQ ID NO: 5044 - protein, 215 aa, Artificial Sequence
  Description of Artificial Sequence: Synthetic polypeptide
  XENP019491 [CTLA-4]_H0_L0.76_Fab Light Chain
EIVLTQSPGTLSLSPGERATLSCRASQSVGSSYLAWYQQKPGQAPRLLIYGAFGRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5045 - protein, 108 aa, Artificial Sequence; identical to SEQ ID NO: 2093
  Description of Artificial Sequence: Synthetic polypeptide
  VL of XENP019491

SEQ ID NO: 5046 - protein, 12 aa, Artificial Sequence
  Description of Artificial Sequence: Synthetic peptide
  XENP019491 vlCDR1
RASQSVGSSYLA

SEQ ID NO: 5047 - protein, 7 aa, Artificial Sequence
  Description of Artificial Sequence: Synthetic peptide
  XENP019491 vlCDR2
GAFGRAT

SEQ ID NO: 5048 - protein, 9 aa, Artificial Sequence
  Description of Artificial Sequence: Synthetic peptide
  XENP019491 vlCDR3
QQYGSSPWT

SEQ ID NO: 5049 - protein, 221 aa, Artificial Sequence; identical to SEQ ID NO: 2919
  Description of Artificial Sequence: Synthetic polypeptide
  XENP019492 [CTLA-4]_H0_L0.77_Fab Heavy Chain

SEQ ID NO: 5050 - protein, 118 aa, Artificial Sequence; identical to SEQ ID NO: 22
  Description of Artificial Sequence: Synthetic polypeptide
  VH of XENP019492

SEQ ID NO: 5051 - protein, 5 aa, Artificial Sequence
  Description of Artificial Sequence: Synthetic peptide
  XENP019492 vhCDR1
SYTMH

SEQ ID NO: 5052 - protein, 17 aa, Artificial Sequence
  Description of Artificial Sequence: Synthetic peptide
  XENP019492 vhCDR2
FISYDGNNKYYADSVKG

SEQ ID NO: 5053 - protein, 9 aa, Artificial Sequence
  Description of Artificial Sequence: Synthetic peptide
  XENP019492 vhCDR3
TGWLGPFDY

SEQ ID NO: 5054 - protein, 215 aa, Artificial Sequence
  Description of Artificial Sequence: Synthetic polypeptide
  XENP019492 [CTLA-4]_H0_L0.77_Fab Light Chain
EIVLTQSPGTLSLSPGERATLSCRASQSVGSSYLAWYQQKPGQAPRLLIYGAFNRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5055 - protein, 108 aa, Artificial Sequence; identical to SEQ ID NO: 2102
  Description of Artificial Sequence: Synthetic polypeptide
  VL of XENP019492

SEQ ID NO: 5056 - protein, 12 aa, Artificial Sequence
  Description of Artificial Sequence: Synthetic peptide
  XENP019492 vlCDR1
RASQSVGSSYLA

SEQ ID NO: 5057 - protein, 7 aa, Artificial Sequence
  Description of Artificial Sequence: Synthetic peptide
  XENP019492 vlCDR2
GAFNRAT

SEQ ID NO: 5058 - protein, 9 aa, Artificial Sequence
  Description of Artificial Sequence: Synthetic peptide
  XENP019492 vlCDR3
QQYGSSPWT

SEQ ID NO: 5059 - protein, 221 aa, Artificial Sequence; identical to SEQ ID NO: 2919
  Description of Artificial Sequence: Synthetic polypeptide
  XENP019493 [CTLA-4]_H0_L0.78_Fab Heavy Chain

SEQ ID NO: 5060 - protein, 118 aa, Artificial Sequence; identical to SEQ ID NO: 22
  Description of Artificial Sequence: Synthetic polypeptide
  VH of XENP019493

SEQ ID NO: 5061 - protein, 5 aa, Artificial Sequence
  Description of Artificial Sequence: Synthetic peptide
  XENP019493 vhCDR1
SYTMH

SEQ ID NO: 5062 - protein, 17 aa, Artificial Sequence
  Description of Artificial Sequence: Synthetic peptide
  XENP019493 vhCDR2
FISYDGNNKYYADSVKG

SEQ ID NO: 5063 - protein, 9 aa, Artificial Sequence
  Description of Artificial Sequence: Synthetic peptide
  XENP019493 vhCDR3
TGWLGPFDY

SEQ ID NO: 5064 - protein, 215 aa, Artificial Sequence
  Description of Artificial Sequence: Synthetic polypeptide
  XENP019493 [CTLA-4]_H0_L0.78_Fab Light Chain
EIVLTQSPGTLSLSPGERATLSCRASQSVGSSYLAWYQQKPGQAPRLLIYGAFQRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5065 - protein, 108 aa, Artificial Sequence; identical to SEQ ID NO: 2111
  Description of Artificial Sequence: Synthetic polypeptide
  VL of XENP019493

SEQ ID NO: 5066 - protein, 12 aa, Artificial Sequence
  Description of Artificial Sequence: Synthetic peptide
  XENP019493 vlCDR1
RASQSVGSSYLA

SEQ ID NO: 5067 - protein, 7 aa, Artificial Sequence
  Description of Artificial Sequence: Synthetic peptide
  XENP019493 vlCDR2
GAFQRAT

SEQ ID NO: 5068 - protein, 9 aa, Artificial Sequence
  Description of Artificial Sequence: Synthetic peptide
  XENP019493 vlCDR3
QQYGSSPWT

SEQ ID NO: 5069 - protein, 221 aa, Artificial Sequence; identical to SEQ ID NO: 2919
  Description of Artificial Sequence: Synthetic polypeptide
  XENP019494 [CTLA-4]_H0_L0.79_Fab Heavy Chain

SEQ ID NO: 5070 - protein, 118 aa, Artificial Sequence; identical to SEQ ID NO: 22
  Description of Artificial Sequence: Synthetic polypeptide
  VH of XENP019494

SEQ ID NO: 5071 - protein, 5 aa, Artificial Sequence
  Description of Artificial Sequence: Synthetic peptide
  XENP019494 vhCDR1
SYTMH

SEQ ID NO: 5072 - protein, 17 aa, Artificial Sequence
  Description of Artificial Sequence: Synthetic peptide
  XENP019494 vhCDR2
FISYDGNNKYYADSVKG

SEQ ID NO: 5073 - protein, 9 aa, Artificial Sequence
  Description of Artificial Sequence: Synthetic peptide
  XENP019494 vhCDR3
TGWLGPFDY

SEQ ID NO: 5074 - protein, 215 aa, Artificial Sequence
  Description of Artificial Sequence: Synthetic polypeptide
  XENP019494 [CTLA-4]_H0_L0.79_Fab Light Chain
EIVLTQSPGTLSLSPGERATLSCRASQSVGSSYLAWYQQKPGQAPRLLIYGAFTRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5075 - protein, 108 aa, Artificial Sequence; identical to SEQ ID NO: 2120
  Description of Artificial Sequence: Synthetic polypeptide
  VL of XENP019494

SEQ ID NO: 5076 - protein, 12 aa, Artificial Sequence
  Description of Artificial Sequence: Synthetic peptide
  XENP019494 vlCDR1
RASQSVGSSYLA

SEQ ID NO: 5077 - protein, 7 aa, Artificial Sequence
  Description of Artificial Sequence: Synthetic peptide
  XENP019494 vlCDR2
GAFTRAT

SEQ ID NO: 5078 - protein, 9 aa, Artificial Sequence
  Description of Artificial Sequence: Synthetic peptide
  XENP019494 vlCDR3
QQYGSSPWT

SEQ ID NO: 5079 - protein, 221 aa, Artificial Sequence; identical to SEQ ID NO: 2919
  Description of Artificial Sequence: Synthetic polypeptide
  XENP019495 [CTLA-4]_H0_L0.80_Fab Heavy Chain

SEQ ID NO: 5080 - protein, 118 aa, Artificial Sequence; identical to SEQ ID NO: 22
  Description of Artificial Sequence: Synthetic polypeptide
  VH of XENP019495

SEQ ID NO: 5081 - protein, 5 aa, Artificial Sequence
  Description of Artificial Sequence: Synthetic peptide
  XENP019495 vhCDR1
SYTMH

SEQ ID NO: 5082 - protein, 17 aa, Artificial Sequence
  Description of Artificial Sequence: Synthetic peptide
  XENP019495 vhCDR2
FISYDGNNKYYADSVKG

SEQ ID NO: 5083 - protein, 9 aa, Artificial Sequence
  Description of Artificial Sequence: Synthetic peptide
  XENP019495 vhCDR3
TGWLGPFDY

SEQ ID NO: 5084 - protein, 215 aa, Artificial Sequence
  Description of Artificial Sequence: Synthetic polypeptide
  XENP019495 [CTLA-4]_H0_L0.80_Fab Light Chain
EIVLTQSPGTLSLSPGERATLSCRASQSVGSSYLAWYQQKPGQAPRLLIYGAFSRDTGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5085 - protein, 108 aa, Artificial Sequence; identical to SEQ ID NO: 2129
  Description of Artificial Sequence: Synthetic polypeptide
  VL of XENP019495

SEQ ID NO: 5086 - protein, 12 aa, Artificial Sequence
  Description of Artificial Sequence: Synthetic peptide
  XENP019495 vlCDR1
RASQSVGSSYLA

SEQ ID NO: 5087 - protein, 7 aa, Artificial Sequence
  Description of Artificial Sequence: Synthetic peptide
  XENP019495 vlCDR2
GAFSRDT

SEQ ID NO: 5088 - protein, 9 aa, Artificial Sequence
  Description of Artificial Sequence: Synthetic peptide
  XENP019495 vlCDR3
QQYGSSPWT

SEQ ID NO: 5089 - protein, 221 aa, Artificial Sequence; identical to SEQ ID NO: 2919
  Description of Artificial Sequence: Synthetic polypeptide
  XENP019496 [CTLA-4]_H0_L0.81_Fab Heavy Chain

SEQ ID NO: 5090 - protein, 118 aa, Artificial Sequence; identical to SEQ ID NO: 22
  Description of Artificial Sequence: Synthetic polypeptide
  VH of XENP019496

SEQ ID NO: 5091 - protein, 5 aa, Artificial Sequence
  Description of Artificial Sequence: Synthetic peptide
  XENP019496 vhCDR1
SYTMH

SEQ ID NO: 5092 - protein, 17 aa, Artificial Sequence
  Description of Artificial Sequence: Synthetic peptide
  XENP019496 vhCDR2
FISYDGNNKYYADSVKG

SEQ ID NO: 5093 - protein, 9 aa, Artificial Sequence
  Description of Artificial Sequence: Synthetic peptide
  XENP019496 vhCDR3
TGWLGPFDY

SEQ ID NO: 5094 - protein, 215 aa, Artificial Sequence
  Description of Artificial Sequence: Synthetic polypeptide
  XENP019496 [CTLA-4]_H0_L0.81_Fab Light Chain
EIVLTQSPGTLSLSPGERATLSCRASQSVGSSYLAWYQQKPGQAPRLLIYGAFSRASGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5095 - protein, 108 aa, Artificial Sequence; identical to SEQ ID NO: 2138
  Description of Artificial Sequence: Synthetic polypeptide
  VL of XENP019496

SEQ ID NO: 5096 - protein, 12 aa, Artificial Sequence
  Description of Artificial Sequence: Synthetic peptide
  XENP019496 vlCDR1
RASQSVGSSYLA

SEQ ID NO: 5097 - protein, 7 aa, Artificial Sequence
  Description of Artificial Sequence: Synthetic peptide
  XENP019496 vlCDR2
GAFSRAS

SEQ ID NO: 5098 - protein, 9 aa, Artificial Sequence
  Description of Artificial Sequence: Synthetic peptide
  XENP019496 vlCDR3
QQYGSSPWT

SEQ ID NO: 5099 - protein, 221 aa, Artificial Sequence; identical to SEQ ID NO: 2919
  Description of Artificial Sequence: Synthetic polypeptide
  XENP019501 [CTLA-4]_H0_L0.82_Fab Heavy Chain

SEQ ID NO: 5100 - protein, 118 aa, Artificial Sequence; identical to SEQ ID NO: 22
  Description of Artificial Sequence: Synthetic polypeptide
  VH of XENP019501

SEQ ID NO: 5101 - protein, 5 aa, Artificial Sequence
  Description of Artificial Sequence: Synthetic peptide
  XENP019501 vhCDR1
SYTMH

SEQ ID NO: 5102 - protein, 17 aa, Artificial Sequence
  Description of Artificial Sequence: Synthetic peptide
  XENP019501 vhCDR2
FISYDGNNKYYADSVKG

SEQ ID NO: 5103 - protein, 9 aa, Artificial Sequence
  Description of Artificial Sequence: Synthetic peptide
  XENP019501 vhCDR3
TGWLGPFDY

SEQ ID NO: 5104 - protein, 215 aa, Artificial Sequence
  Description of Artificial Sequence: Synthetic polypeptide
  XENP019501 [CTLA-4]_H0_L0.82_Fab Light Chain
EIVLTQSPGTLSLSPGERATLSCRASQSVGSSYLAWYQQKPGQAPRLLIYGAFSRATGVPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5105 - protein, 108 aa, Artificial Sequence; identical to SEQ ID NO: 2147
  Description of Artificial Sequence: Synthetic polypeptide
  VL of XENP019501

SEQ ID NO: 5106 - protein, 12 aa, Artificial Sequence
  Description of Artificial Sequence: Synthetic peptide
  XENP019501 vlCDR1
RASQSVGSSYLA

SEQ ID NO: 5107 - protein, 7 aa, Artificial Sequence
  Description of Artificial Sequence: Synthetic peptide
  XENP019501 vlCDR2
GAFSRAT

SEQ ID NO: 5108 - protein, 9 aa, Artificial Sequence
  Description of Artificial Sequence: Synthetic peptide
  XENP019501 vlCDR3
QQYGSSPWT

SEQ ID NO: 5109 - protein, 221 aa, Artificial Sequence; identical to SEQ ID NO: 2919
  Description of Artificial Sequence: Synthetic polypeptide
  XENP019502 [CTLA-4]_H0_L0.83_Fab Heavy Chain

SEQ ID NO: 5110 - protein, 118 aa, Artificial Sequence; identical to SEQ ID NO: 22
  Description of Artificial Sequence: Synthetic polypeptide
  VH of XENP019502

SEQ ID NO: 5111 - protein, 5 aa, Artificial Sequence
  Description of Artificial Sequence: Synthetic peptide
  XENP019502 vhCDR1
SYTMH

SEQ ID NO: 5112 - protein, 17 aa, Artificial Sequence
  Description of Artificial Sequence: Synthetic peptide
  XENP019502 vhCDR2
FISYDGNNKYYADSVKG

SEQ ID NO: 5113 - protein, 9 aa, Artificial Sequence
  Description of Artificial Sequence: Synthetic peptide
  XENP019502 vhCDR3
TGWLGPFDY

SEQ ID NO: 5114 - protein, 215 aa, Artificial Sequence
  Description of Artificial Sequence: Synthetic polypeptide
  XENP019502 [CTLA-4]_H0_L0.83_Fab Light Chain
EIVLTQSPGTLSLSPGERATLSCRASQSVGSSYLAWYQQKPGQAPRLLIYGAFSRATGIPARFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5115 - protein, 108 aa, Artificial Sequence; identical to SEQ ID NO: 2156
  Description of Artificial Sequence: Synthetic polypeptide
  VL of XENP019502

SEQ ID NO: 5116 - protein, 12 aa, Artificial Sequence
  Description of Artificial Sequence: Synthetic peptide
  XENP019502 vlCDR1
RASQSVGSSYLA

SEQ ID NO: 5117 - protein, 7 aa, Artificial Sequence
  Description of Artificial Sequence: Synthetic peptide
  XENP019502 vlCDR2
GAFSRAT

SEQ ID NO: 5118 - protein, 9 aa, Artificial Sequence
  Description of Artificial Sequence: Synthetic peptide
  XENP019502 vlCDR3
QQYGSSPWT

SEQ ID NO: 5119 - protein, 221 aa, Artificial Sequence; identical to SEQ ID NO: 2919
  Description of Artificial Sequence: Synthetic polypeptide
  XENP019503 [CTLA-4]_H0_L0.84_Fab Heavy Chain

SEQ ID NO: 5120 - protein, 118 aa, Artificial Sequence; identical to SEQ ID NO: 22
  Description of Artificial Sequence: Synthetic polypeptide
  VH of XENP019503

SEQ ID NO: 5121 - protein, 5 aa, Artificial Sequence
  Description of Artificial Sequence: Synthetic peptide
  XENP019503 vhCDR1
SYTMH

SEQ ID NO: 5122 - protein, 17 aa, Artificial Sequence
  Description of Artificial Sequence: Synthetic peptide
  XENP019503 vhCDR2
FISYDGNNKYYADSVKG

SEQ ID NO: 5123 - protein, 9 aa, Artificial Sequence
  Description of Artificial Sequence: Synthetic peptide
  XENP019503 vhCDR3
TGWLGPFDY

SEQ ID NO: 5124 - protein, 215 aa, Artificial Sequence
  Description of Artificial Sequence: Synthetic polypeptide
  XENP019503 [CTLA-4]_H0_L0.84_Fab Light Chain
EIVLTQSPGTLSLSPGERATLSCRASQSVGSSYLAWYQQKPGQAPRLLIYGAFSRATGIPDRFSGSGSRTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5125 - protein, 108 aa, Artificial Sequence; identical to SEQ ID NO: 2165
  Description of Artificial Sequence: Synthetic polypeptide
  VL of XENP019503

SEQ ID NO: 5126 - protein, 12 aa, Artificial Sequence
  Description of Artificial Sequence: Synthetic peptide
  XENP019503 vlCDR1
RASQSVGSSYLA

SEQ ID NO: 5127 - protein, 7 aa, Artificial Sequence
  Description of Artificial Sequence: Synthetic peptide
  XENP019503 vlCDR2
GAFSRAT

SEQ ID NO: 5128 - protein, 9 aa, Artificial Sequence
  Description of Artificial Sequence: Synthetic peptide
  XENP019503 vlCDR3
QQYGSSPWT

SEQ ID NO: 5129 - protein, 221 aa, Artificial Sequence; identical to SEQ ID NO: 2919
  Description of Artificial Sequence: Synthetic polypeptide
  XENP019504 [CTLA-4]_H0_L0.85_Fab Heavy Chain

SEQ ID NO: 5130 - protein, 118 aa, Artificial Sequence; identical to SEQ ID NO: 22
  Description of Artificial Sequence: Synthetic polypeptide
  VH of XENP019504

SEQ ID NO: 5131 - protein, 5 aa, Artificial Sequence
  Description of Artificial Sequence: Synthetic peptide
  XENP019504 vhCDR1
SYTMH

SEQ ID NO: 5132 - protein, 17 aa, Artificial Sequence
  Description of Artificial Sequence: Synthetic peptide
  XENP019504 vhCDR2
FISYDGNNKYYADSVKG

SEQ ID NO: 5133 - protein, 9 aa, Artificial Sequence
  Description of Artificial Sequence: Synthetic peptide
  XENP019504 vhCDR3
TGWLGPFDY

SEQ ID NO: 5134 - protein, 215 aa, Artificial Sequence
  Description of Artificial Sequence: Synthetic polypeptide
  XENP019504 [CTLA-4]_H0_L0.85_Fab Light Chain
EIVLTQSPGTLSLSPGERATLSCRASQSVGSSYLAWYQQKPGQAPRLLIYGAFSRATGIPDRFSGSGSGTEFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5135 - protein, 108 aa, Artificial Sequence; identical to SEQ ID NO: 2174
  Description of Artificial Sequence: Synthetic polypeptide
  VL of XENP019504

SEQ ID NO: 5136 - protein, 12 aa, Artificial Sequence
  Description of Artificial Sequence: Synthetic peptide
  XENP019504 vlCDR1
RASQSVGSSYLA

SEQ ID NO: 5137 - protein, 7 aa, Artificial Sequence
  Description of Artificial Sequence: Synthetic peptide
  XENP019504 vlCDR2
GAFSRAT

SEQ ID NO: 5138 - protein, 9 aa, Artificial Sequence
  Description of Artificial Sequence: Synthetic peptide
  XENP019504 vlCDR3
QQYGSSPWT

SEQ ID NO: 5139 - protein, 221 aa, Artificial Sequence; identical to SEQ ID NO: 2919
  Description of Artificial Sequence: Synthetic polypeptide
  XENP019505 [CTLA-4]_H0_L0.86_Fab Heavy Chain

SEQ ID NO: 5140 - protein, 118 aa, Artificial Sequence; identical to SEQ ID NO: 22
  Description of Artificial Sequence: Synthetic polypeptide
  VH of XENP019505

SEQ ID NO: 5141 - protein, 5 aa, Artificial Sequence
  Description of Artificial Sequence: Synthetic peptide
  XENP019505 vhCDR1
SYTMH

SEQ ID NO: 5142 - protein, 17 aa, Artificial Sequence
  Description of Artificial Sequence: Synthetic peptide
  XENP019505 vhCDR2
FISYDGNNKYYADSVKG

SEQ ID NO: 5143 - protein, 9 aa, Artificial Sequence
  Description of Artificial Sequence: Synthetic peptide
  XENP019505 vhCDR3
TGWLGPFDY

SEQ ID NO: 5144 - protein, 215 aa, Artificial Sequence
  Description of Artificial Sequence: Synthetic polypeptide
  XENP019505 [CTLA-4]_H0_L0.86_Fab Light Chain
EIVLTQSPGTLSLSPGERATLSCRASQSVGSSYLAWYQQKPGQAPRLLIYGAFSRATGIPDRFSGSGSGTDFTLKISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5145 - protein, 108 aa, Artificial Sequence; identical to SEQ ID NO: 2183
  Description of Artificial Sequence: Synthetic polypeptide
  VL of XENP019505

SEQ ID NO: 5146 - protein, 12 aa, Artificial Sequence
  Description of Artificial Sequence: Synthetic peptide
  XENP019505 vlCDR1
RASQSVGSSYLA

SEQ ID NO: 5147 - protein, 7 aa, Artificial Sequence
  Description of Artificial Sequence: Synthetic peptide
  XENP019505 vlCDR2
GAFSRAT

SEQ ID NO: 5148 - protein, 9 aa, Artificial Sequence
  Description of Artificial Sequence: Synthetic peptide
  XENP019505 vlCDR3
QQYGSSPWT

SEQ ID NO: 5149 - protein, 221 aa, Artificial Sequence; identical to SEQ ID NO: 2919
  Description of Artificial Sequence: Synthetic polypeptide
  XENP019506 [CTLA-4]_H0_L0.87_Fab Heavy Chain

SEQ ID NO: 5150 - protein, 118 aa, Artificial Sequence; identical to SEQ ID NO: 22
  Description of Artificial Sequence: Synthetic polypeptide
  VH of XENP019506

SEQ ID NO: 5151 - protein, 5 aa, Artificial Sequence
  Description of Artificial Sequence: Synthetic peptide
  XENP019506 vhCDR1
SYTMH

SEQ ID NO: 5152 - protein, 17 aa, Artificial Sequence
  Description of Artificial Sequence: Synthetic peptide
  XENP019506 vhCDR2
FISYDGNNKYYADSVKG

SEQ ID NO: 5153 - protein, 9 aa, Artificial Sequence
  Description of Artificial Sequence: Synthetic peptide
  XENP019506 vhCDR3
TGWLGPFDY

SEQ ID NO: 5154 - protein, 215 aa, Artificial Sequence
  Description of Artificial Sequence: Synthetic polypeptide
  XENP019506 [CTLA-4]_H0_L0.87_Fab Light Chain
EIVLTQSPGTLSLSPGERATLSCRASQSVGSSYLAWYQQKPGQAPRLLIYGAFSRATGIPDRFSGSGSGTDFTLTISSLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5155 - protein, 108 aa, Artificial Sequence; identical to SEQ ID NO: 2192
  Description of Artificial Sequence: Synthetic polypeptide
  VL of XENP019506

SEQ ID NO: 5156 - protein, 12 aa, Artificial Sequence
  Description of Artificial Sequence: Synthetic peptide
  XENP019506 vlCDR1
RASQSVGSSYLA

SEQ ID NO: 5157 - protein, 7 aa, Artificial Sequence
  Description of Artificial Sequence: Synthetic peptide
  XENP019506 vlCDR2
GAFSRAT

SEQ ID NO: 5158 - protein, 9 aa, Artificial Sequence
  Description of Artificial Sequence: Synthetic peptide
  XENP019506 vlCDR3
QQYGSSPWT

SEQ ID NO: 5159 - protein, 221 aa, Artificial Sequence; identical to SEQ ID NO: 2919
  Description of Artificial Sequence: Synthetic polypeptide
  XENP019507 [CTLA-4]_H0_L0.88_Fab Heavy Chain

SEQ ID NO: 5160 - protein, 118 aa, Artificial Sequence; identical to SEQ ID NO: 22
  Description of Artificial Sequence: Synthetic polypeptide
  VH of XENP019507

SEQ ID NO: 5161 - protein, 5 aa, Artificial Sequence
  Description of Artificial Sequence: Synthetic peptide
  XENP019507 vhCDR1
SYTMH

SEQ ID NO: 5162 - protein, 17 aa, Artificial Sequence
  Description of Artificial Sequence: Synthetic peptide
  XENP019507 vhCDR2
FISYDGNNKYYADSVKG

SEQ ID NO: 5163 - protein, 9 aa, Artificial Sequence
  Description of Artificial Sequence: Synthetic peptide
  XENP019507 vhCDR3
TGWLGPFDY

SEQ ID NO: 5164 - protein, 215 aa, Artificial Sequence
  Description of Artificial Sequence: Synthetic polypeptide
  XENP019507 [CTLA-4]_H0_L0.88_Fab Light Chain
EIVLTQSPGTLSLSPGERATLSCRASQSVGSSYLAWYQQKPGQAPRLLIYGAFSRATGIPDRFSGSGSGTDFTLTISSLQSEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5165 - protein, 108 aa, Artificial Sequence; identical to SEQ ID NO: 2201
  Description of Artificial Sequence: Synthetic polypeptide
  VL of XENP019507

SEQ ID NO: 5166 - protein, 12 aa, Artificial Sequence
  Description of Artificial Sequence: Synthetic peptide
  XENP019507 vlCDR1
RASQSVGSSYLA

SEQ ID NO: 5167 - protein, 7 aa, Artificial Sequence
  Description of Artificial Sequence: Synthetic peptide
  XENP019507 vlCDR2
GAFSRAT

SEQ ID NO: 5168 - protein, 9 aa, Artificial Sequence
  Description of Artificial Sequence: Synthetic peptide
  XENP019507 vlCDR3
QQYGSSPWT

SEQ ID NO: 5169 - protein, 221 aa, Artificial Sequence; identical to SEQ ID NO: 2919
  Description of Artificial Sequence: Synthetic polypeptide
  XENP019508 [CTLA-4]_H0_L0.89_Fab Heavy Chain

SEQ ID NO: 5170 - protein, 118 aa, Artificial Sequence; identical to SEQ ID NO: 22
  Description of Artificial Sequence: Synthetic polypeptide
  VH of XENP019508

SEQ ID NO: 5171 - protein, 5 aa, Artificial Sequence
  Description of Artificial Sequence: Synthetic peptide
  XENP019508 vhCDR1
SYTMH

SEQ ID NO: 5172 - protein, 17 aa, Artificial Sequence
  Description of Artificial Sequence: Synthetic peptide
  XENP019508 vhCDR2
FISYDGNNKYYADSVKG

SEQ ID NO: 5173 - protein, 9 aa, Artificial Sequence
  Description of Artificial Sequence: Synthetic peptide
  XENP019508 vhCDR3
TGWLGPFDY

SEQ ID NO: 5174 - protein, 215 aa, Artificial Sequence
  Description of Artificial Sequence: Synthetic polypeptide
  XENP019508 [CTLA-4]_H0_L0.89_Fab Light Chain
EIVLTQSPGTLSLSPGERATLSCRASQSVGSSYLAWYQQKPGQAPRLLIYGAFSRATGIPDRFSGSGSGTDFTLTISRVEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5175 - protein, 108 aa, Artificial Sequence; identical to SEQ ID NO: 2210
  Description of Artificial Sequence: Synthetic polypeptide
  VL of XENP019508

SEQ ID NO: 5176 - protein, 12 aa, Artificial Sequence
  Description of Artificial Sequence: Synthetic peptide
  XENP019508 vlCDR1
RASQSVGSSYLA

SEQ ID NO: 5177 - protein, 7 aa, Artificial Sequence
  Description of Artificial Sequence: Synthetic peptide
  XENP019508 vlCDR2
GAFSRAT

SEQ ID NO: 5178 - protein, 9 aa, Artificial Sequence
  Description of Artificial Sequence: Synthetic peptide
  XENP019508 vlCDR3
QQYGSSPWT

SEQ ID NO: 5179 - protein, 221 aa, Artificial Sequence; identical to SEQ ID NO: 2919
  Description of Artificial Sequence: Synthetic polypeptide
  XENP019509 [CTLA-4]_H0_L0.90_Fab Heavy Chain

SEQ ID NO: 5180 - protein, 118 aa, Artificial Sequence; identical to SEQ ID NO: 22
  Description of Artificial Sequence: Synthetic polypeptide
  VH of XENP019509

SEQ ID NO: 5181 - protein, 5 aa, Artificial Sequence
  Description of Artificial Sequence: Synthetic peptide
  XENP019509 vhCDR1
SYTMH

SEQ ID NO: 5182 - protein, 17 aa, Artificial Sequence
  Description of Artificial Sequence: Synthetic peptide
  XENP019509 vhCDR2
FISYDGNNKYYADSVKG

SEQ ID NO: 5183 - protein, 9 aa, Artificial Sequence
  Description of Artificial Sequence: Synthetic peptide
  XENP019509 vhCDR3
TGWLGPFDY

SEQ ID NO: 5184 - protein, 215 aa, Artificial Sequence
  Description of Artificial Sequence: Synthetic polypeptide
  XENP019509 [CTLA-4]_H0_L0.90_Fab Light Chain
EIVLTQSPGTLSLSPGERATLSCRASQSVGSSYLAWYQQKPGQAPRLLIYGAFSRATGIPDRFSGSGSGTDFTLTISRLQPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5185 - protein, 108 aa, Artificial Sequence; identical to SEQ ID NO: 2219
  Description of Artificial Sequence: Synthetic polypeptide
  VL of XENP019509

SEQ ID NO: 5186 - protein, 12 aa, Artificial Sequence
  Description of Artificial Sequence: Synthetic peptide
  XENP019509 vlCDR1
RASQSVGSSYLA

SEQ ID NO: 5187 - protein, 7 aa, Artificial Sequence
  Description of Artificial Sequence: Synthetic peptide
  XENP019509 vlCDR2
GAFSRAT

SEQ ID NO: 5188 - protein, 9 aa, Artificial Sequence
  Description of Artificial Sequence: Synthetic peptide
  XENP019509 vlCDR3
QQYGSSPWT

SEQ ID NO: 5189 - protein, 221 aa, Artificial Sequence; identical to SEQ ID NO: 2919
  Description of Artificial Sequence: Synthetic polypeptide
  XENP019510 [CTLA-4]_H0_L0.91_Fab Heavy Chain

SEQ ID NO: 5190 - protein, 118 aa, Artificial Sequence; identical to SEQ ID NO: 22
  Description of Artificial Sequence: Synthetic polypeptide
  VH of XENP019510

SEQ ID NO: 5191 - protein, 5 aa, Artificial Sequence
  Description of Artificial Sequence: Synthetic peptide
  XENP019510 vhCDR1
SYTMH

SEQ ID NO: 5192 - protein, 17 aa, Artificial Sequence
  Description of Artificial Sequence: Synthetic peptide
  XENP019510 vhCDR2
FISYDGNNKYYADSVKG

SEQ ID NO: 5193 - protein, 9 aa, Artificial Sequence
  Description of Artificial Sequence: Synthetic peptide
  XENP019510 vhCDR3
TGWLGPFDY

SEQ ID NO: 5194 - protein, 215 aa, Artificial Sequence
  Description of Artificial Sequence: Synthetic polypeptide
  XENP019510 [CTLA-4]_H0_L0.91_Fab Light Chain
EIVLTQSPGTLSLSPGERATLSCRASQSVGSSYLAWYQQKPGQAPRLLIYGAFSRATGIPDRFSGSGSGTDFTLTISRLESEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5195 - protein, 108 aa, Artificial Sequence; identical to SEQ ID NO: 2228
  Description of Artificial Sequence: Synthetic polypeptide
  VL of XENP019510

SEQ ID NO: 5196 - protein, 12 aa, Artificial Sequence
  Description of Artificial Sequence: Synthetic peptide
  XENP019510 vlCDR1
RASQSVGSSYLA

SEQ ID NO: 5197 - protein, 7 aa, Artificial Sequence
  Description of Artificial Sequence: Synthetic peptide
  XENP019510 vlCDR2
GAFSRAT

SEQ ID NO: 5198 - protein, 9 aa, Artificial Sequence
  Description of Artificial Sequence: Synthetic peptide
  XENP019510 vlCDR3
QQYGSSPWT

SEQ ID NO: 5199 - protein, 221 aa, Artificial Sequence; identical to SEQ ID NO: 2919
  Description of Artificial Sequence: Synthetic polypeptide
  XENP019511 [CTLA-4]_H0_L0.92_Fab Heavy Chain

SEQ ID NO: 5200 - protein, 118 aa, Artificial Sequence; identical to SEQ ID NO: 22
  Description of Artificial Sequence: Synthetic polypeptide
  VH of XENP019511

SEQ ID NO: 5201 - protein, 5 aa, Artificial Sequence
  Description of Artificial Sequence: Synthetic peptide
  XENP019511 vhCDR1
SYTMH

SEQ ID NO: 5202 - protein, 17 aa, Artificial Sequence
  Description of Artificial Sequence: Synthetic peptide
  XENP019511 vhCDR2
FISYDGNNKYYADSVKG

SEQ ID NO: 5203 - protein, 9 aa, Artificial Sequence
  Description of Artificial Sequence: Synthetic peptide
  XENP019511 vhCDR3
TGWLGPFDY

SEQ ID NO: 5204 - protein, 215 aa, Artificial Sequence
  Description of Artificial Sequence: Synthetic polypeptide
  XENP019511 [CTLA-4]_H0_L0.92_Fab Light Chain
EIVLTQSPGTLSLSPGERATLSCRASQSVGSSYLAWYQQKPGQAPRLLIYGAFSRATGIPDRFSGSGSGTDFTLTISRLEPQDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5205 - protein, 108 aa, Artificial Sequence; identical to SEQ ID NO: 2237
  Description of Artificial Sequence: Synthetic polypeptide
  VL of XENP019511

SEQ ID NO: 5206 - protein, 12 aa, Artificial Sequence
  Description of Artificial Sequence: Synthetic peptide
  XENP019511 vlCDR1
RASQSVGSSYLA

SEQ ID NO: 5207 - protein, 7 aa, Artificial Sequence
  Description of Artificial Sequence: Synthetic peptide
  XENP019511 vlCDR2
GAFSRAT

SEQ ID NO: 5208 - protein, 9 aa, Artificial Sequence
  Description of Artificial Sequence: Synthetic peptide
  XENP019511 vlCDR3
QQYGSSPWT

SEQ ID NO: 5209 - protein, 221 aa, Artificial Sequence; identical to SEQ ID NO: 2919
  Description of Artificial Sequence: Synthetic polypeptide
  XENP019512 [CTLA-4]_H0_L0.93_Fab Heavy Chain

SEQ ID NO: 5210 - protein, 118 aa, Artificial Sequence; identical to SEQ ID NO: 22
  Description of Artificial Sequence: Synthetic polypeptide
  VH of XENP019512

SEQ ID NO: 5211 - protein, 5 aa, Artificial Sequence
  Description of Artificial Sequence: Synthetic peptide
  XENP019512 vhCDR1
SYTMH

SEQ ID NO: 5212 - protein, 17 aa, Artificial Sequence
  Description of Artificial Sequence: Synthetic peptide
  XENP019512 vhCDR2
FISYDGNNKYYADSVKG

SEQ ID NO: 5213 - protein, 9 aa, Artificial Sequence
  Description of Artificial Sequence: Synthetic peptide
  XENP019512 vhCDR3
TGWLGPFDY

SEQ ID NO: 5214 - protein, 215 aa, Artificial Sequence
  Description of Artificial Sequence: Synthetic polypeptide
  XENP019512 [CTLA-4]_H0_L0.93_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCKQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5215 - protein, 108 aa, Artificial Sequence; identical to SEQ ID NO: 2246
  Description of Artificial Sequence: Synthetic polypeptide
  VL of XENP019512

SEQ ID NO: 5216 - protein, 12 aa, Artificial Sequence
  Description of Artificial Sequence: Synthetic peptide
  XENP019512 vlCDR1
RASQSVGSSYLA

SEQ ID NO: 5217 - protein, 7 aa, Artificial Sequence
  Description of Artificial Sequence: Synthetic peptide
  XENP019512 vlCDR2
GAFSRAT

SEQ ID NO: 5218 - protein, 9 aa, Artificial Sequence
  Description of Artificial Sequence: Synthetic peptide
  XENP019512 vlCDR3
KQYGSSPWT

SEQ ID NO: 5219 - protein, 221 aa, Artificial Sequence; identical to SEQ ID NO: 2919
  Description of Artificial Sequence: Synthetic polypeptide
  XENP019513 [CTLA-4]_H0_L0.94_Fab Heavy Chain

SEQ ID NO: 5220 - protein, 118 aa, Artificial Sequence; identical to SEQ ID NO: 22
  Description of Artificial Sequence: Synthetic polypeptide
  VH of XENP019513

SEQ ID NO: 5221 - protein, 5 aa, Artificial Sequence
  Description of Artificial Sequence: Synthetic peptide
  XENP019513 vhCDR1
SYTMH

SEQ ID NO: 5222 - protein, 17 aa, Artificial Sequence
  Description of Artificial Sequence: Synthetic peptide
  XENP019513 vhCDR2
FISYDGNNKYYADSVKG

SEQ ID NO: 5223 - protein, 9 aa, Artificial Sequence
  Description of Artificial Sequence: Synthetic peptide
  XENP019513 vhCDR3
TGWLGPFDY

SEQ ID NO: 5224 - protein, 215 aa, Artificial Sequence
  Description of Artificial Sequence: Synthetic polypeptide
  XENP019513 [CTLA-4]_H0_L0.94_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCLQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5225 - protein, 108 aa, Artificial Sequence; identical to SEQ ID NO: 2255
  Description of Artificial Sequence: Synthetic polypeptide
  VL of XENP019513

SEQ ID NO: 5226 - protein, 12 aa, Artificial Sequence
  Description of Artificial Sequence: Synthetic peptide
  XENP019513 vlCDR1
RASQSVGSSYLA

SEQ ID NO: 5227 - protein, 7 aa, Artificial Sequence
  Description of Artificial Sequence: Synthetic peptide
  XENP019513 vlCDR2
GAFSRAT

SEQ ID NO: 5228 - protein, 9 aa, Artificial Sequence
  Description of Artificial Sequence: Synthetic peptide
  XENP019513 vlCDR3
LQYGSSPWT

SEQ ID NO: 5229 - protein, 221 aa, Artificial Sequence; identical to SEQ ID NO: 2919
  Description of Artificial Sequence: Synthetic polypeptide
  XENP019514 [CTLA-4]_H0_L0.95_Fab Heavy Chain

SEQ ID NO: 5230 - protein, 118 aa, Artificial Sequence; identical to SEQ ID NO: 22
  Description of Artificial Sequence: Synthetic polypeptide
  VH of XENP019514

SEQ ID NO: 5231 - protein, 5 aa, Artificial Sequence
  Description of Artificial Sequence: Synthetic peptide
  XENP019514 vhCDR1
SYTMH

SEQ ID NO: 5232 - protein, 17 aa, Artificial Sequence
  Description of Artificial Sequence: Synthetic peptide
  XENP019514 vhCDR2
FISYDGNNKYYADSVKG

SEQ ID NO: 5233 - protein, 9 aa, Artificial Sequence
  Description of Artificial Sequence: Synthetic peptide
  XENP019514 vhCDR3
TGWLGPFDY

SEQ ID NO: 5234 - protein, 215 aa, Artificial Sequence
  Description of Artificial Sequence: Synthetic polypeptide
  XENP019514 [CTLA-4]_H0_L0.95_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCMQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5235 - protein, 108 aa, Artificial Sequence; identical to SEQ ID NO: 2264
  Description of Artificial Sequence: Synthetic polypeptide
  VL of XENP019514

SEQ ID NO: 5236 - protein, 12 aa, Artificial Sequence
  Description of Artificial Sequence: Synthetic peptide
  XENP019514 vlCDR1
RASQSVGSSYLA

SEQ ID NO: 5237 - protein, 7 aa, Artificial Sequence
  Description of Artificial Sequence: Synthetic peptide
  XENP019514 vlCDR2
GAFSRAT

SEQ ID NO: 5238 - protein, 9 aa, Artificial Sequence
  Description of Artificial Sequence: Synthetic peptide
  XENP019514 vlCDR3
MQYGSSPWT

SEQ ID NO: 5239 - protein, 221 aa, Artificial Sequence; identical to SEQ ID NO: 2919
  Description of Artificial Sequence: Synthetic polypeptide
  XENP019515 [CTLA-4]_H0_L0.96_Fab Heavy Chain

SEQ ID NO: 5240 - protein, 118 aa, Artificial Sequence; identical to SEQ ID NO: 22
  Description of Artificial Sequence: Synthetic polypeptide
  VH of XENP019515

SEQ ID NO: 5241 - protein, 5 aa, Artificial Sequence
  Description of Artificial Sequence: Synthetic peptide
  XENP019515 vhCDR1
SYTMH

SEQ ID NO: 5242 - protein, 17 aa, Artificial Sequence
  Description of Artificial Sequence: Synthetic peptide
  XENP019515 vhCDR2
FISYDGNNKYYADSVKG

SEQ ID NO: 5243 - protein, 9 aa, Artificial Sequence
  Description of Artificial Sequence: Synthetic peptide
  XENP019515 vhCDR3
TGWLGPFDY

SEQ ID NO: 5244 - protein, 215 aa, Artificial Sequence
  Description of Artificial Sequence: Synthetic polypeptide
  XENP019515 [CTLA-4]_H0_L0.96_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQSYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5245 - protein, 108 aa, Artificial Sequence; identical to SEQ ID NO: 2273
  Description of Artificial Sequence: Synthetic polypeptide
  VL of XENP019515

SEQ ID NO: 5246 - protein, 12 aa, Artificial Sequence
  Description of Artificial Sequence: Synthetic peptide
  XENP019515 vlCDR1
RASQSVGSSYLA

SEQ ID NO: 5247 - protein, 7 aa, Artificial Sequence
  Description of Artificial Sequence: Synthetic peptide
  XENP019515 vlCDR2
GAFSRAT

SEQ ID NO: 5248 - protein, 9 aa, Artificial Sequence
  Description of Artificial Sequence: Synthetic peptide
  XENP019515 vlCDR3
QSYGSSPWT

SEQ ID NO: 5249 - protein, 221 aa, Artificial Sequence; identical to SEQ ID NO: 2919
  Description of Artificial Sequence: Synthetic polypeptide
  XENP019516 [CTLA-4]_H0_L0.97_Fab Heavy Chain

SEQ ID NO: 5250 - protein, 118 aa, Artificial Sequence; identical to SEQ ID NO: 22
  Description of Artificial Sequence: Synthetic polypeptide
  VH of XENP019516

SEQ ID NO: 5251 - protein, 5 aa, Artificial Sequence
  Description of Artificial Sequence: Synthetic peptide
  XENP019516 vhCDR1
SYTMH

SEQ ID NO: 5252 - protein, 17 aa, Artificial Sequence
  Description of Artificial Sequence: Synthetic peptide
  XENP019516 vhCDR2
FISYDGNNKYYADSVKG

SEQ ID NO: 5253 - protein, 9 aa, Artificial Sequence
  Description of Artificial Sequence: Synthetic peptide
  XENP019516 vhCDR3
TGWLGPFDY

SEQ ID NO: 5254 - protein, 215 aa, Artificial Sequence
  Description of Artificial Sequence: Synthetic polypeptide
  XENP019516 [CTLA-4]_H0_L0.97_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQAGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5255 - protein, 108 aa, Artificial Sequence; identical to SEQ ID NO: 2282
  Description of Artificial Sequence: Synthetic polypeptide
  VL of XENP019516

SEQ ID NO: 5256 - protein, 12 aa, Artificial Sequence
  Description of Artificial Sequence: Synthetic peptide
  XENP019516 vlCDR1
RASQSVGSSYLA

SEQ ID NO: 5257 - protein, 7 aa, Artificial Sequence
  Description of Artificial Sequence: Synthetic peptide
  XENP019516 vlCDR2
GAFSRAT

SEQ ID NO: 5258 - protein, 9 aa, Artificial Sequence
  Description of Artificial Sequence: Synthetic peptide
  XENP019516 vlCDR3
QQAGSSPWT

SEQ ID NO: 5259 - protein, 221 aa, Artificial Sequence; identical to SEQ ID NO: 2919
  Description of Artificial Sequence: Synthetic polypeptide
  XENP019517 [CTLA-4]_H0_L0.98_Fab Heavy Chain

SEQ ID NO: 5260 - protein, 118 aa, Artificial Sequence; identical to SEQ ID NO: 22
  Description of Artificial Sequence: Synthetic polypeptide
  VH of XENP019517

SEQ ID NO: 5261 - protein, 5 aa, Artificial Sequence
  Description of Artificial Sequence: Synthetic peptide
  XENP019517 vhCDR1
SYTMH

SEQ ID NO: 5262 - protein, 17 aa, Artificial Sequence
  Description of Artificial Sequence: Synthetic peptide
  XENP019517 vhCDR2
FISYDGNNKYYADSVKG

SEQ ID NO: 5263 - protein, 9 aa, Artificial Sequence
  Description of Artificial Sequence: Synthetic peptide
  XENP019517 vhCDR3
TGWLGPFDY

SEQ ID NO: 5264 - protein, 215 aa, Artificial Sequence
  Description of Artificial Sequence: Synthetic polypeptide
  XENP019517 [CTLA-4]_H0_L0.98_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQFGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5265 - protein, 108 aa, Artificial Sequence; identical to SEQ ID NO: 2291
  Description of Artificial Sequence: Synthetic polypeptide
  VL of XENP019517

SEQ ID NO: 5266 - protein, 12 aa, Artificial Sequence
  Description of Artificial Sequence: Synthetic peptide
  XENP019517 vlCDR1
RASQSVGSSYLA

SEQ ID NO: 5267 - protein, 7 aa, Artificial Sequence
  Description of Artificial Sequence: Synthetic peptide
  XENP019517 vlCDR2
GAFSRAT

SEQ ID NO: 5268 - protein, 9 aa, Artificial Sequence
  Description of Artificial Sequence: Synthetic peptide
  XENP019517 vlCDR3
QQFGSSPWT

SEQ ID NO: 5269 - protein, 221 aa, Artificial Sequence; identical to SEQ ID NO: 2919
  Description of Artificial Sequence: Synthetic polypeptide
  XENP019518 [CTLA-4]_H0_L0.99_Fab Heavy Chain

SEQ ID NO: 5270 - protein, 118 aa, Artificial Sequence; identical to SEQ ID NO: 22
  Description of Artificial Sequence: Synthetic polypeptide
  VH of XENP019518

SEQ ID NO: 5271 - protein, 5 aa, Artificial Sequence
  Description of Artificial Sequence: Synthetic peptide
  XENP019518 vhCDR1
SYTMH

SEQ ID NO: 5272 - protein, 17 aa, Artificial Sequence
  Description of Artificial Sequence: Synthetic peptide
  XENP019518 vhCDR2
FISYDGNNKYYADSVKG

SEQ ID NO: 5273 - protein, 9 aa, Artificial Sequence
  Description of Artificial Sequence: Synthetic peptide
  XENP019518 vhCDR3
TGWLGPFDY

SEQ ID NO: 5274 - protein, 215 aa, Artificial Sequence
  Description of Artificial Sequence: Synthetic polypeptide
  XENP019518 [CTLA-4]_H0_L0.99_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQHGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5275 - protein, 108 aa, Artificial Sequence; identical to SEQ ID NO: 2300
  Description of Artificial Sequence: Synthetic polypeptide
  VL of XENP019518

SEQ ID NO: 5276 - protein, 12 aa, Artificial Sequence
  Description of Artificial Sequence: Synthetic peptide
  XENP019518 vlCDR1
RASQSVGSSYLA

SEQ ID NO: 5277 - protein, 7 aa, Artificial Sequence
  Description of Artificial Sequence: Synthetic peptide
  XENP019518 vlCDR2
GAFSRAT

SEQ ID NO: 5278 - protein, 9 aa, Artificial Sequence
  Description of Artificial Sequence: Synthetic peptide
  XENP019518 vlCDR3
QQHGSSPWT

SEQ ID NO: 5279 - protein, 221 aa, Artificial Sequence; identical to SEQ ID NO: 2919
  Description of Artificial Sequence: Synthetic polypeptide
  XENP019519 [CTLA-4]_H0_L0.100_Fab Heavy Chain

SEQ ID NO: 5280 - protein, 118 aa, Artificial Sequence; identical to SEQ ID NO: 22
  Description of Artificial Sequence: Synthetic polypeptide
  VH of XENP019519

SEQ ID NO: 5281 - protein, 5 aa, Artificial Sequence
  Description of Artificial Sequence: Synthetic peptide
  XENP019519 vhCDR1
SYTMH

SEQ ID NO: 5282 - protein, 17 aa, Artificial Sequence
  Description of Artificial Sequence: Synthetic peptide
  XENP019519 vhCDR2
FISYDGNNKYYADSVKG

SEQ ID NO: 5283 - protein, 9 aa, Artificial Sequence
  Description of Artificial Sequence: Synthetic peptide
  XENP019519 vhCDR3
TGWLGPFDY

SEQ ID NO: 5284 - protein, 215 aa, Artificial Sequence
  Description of Artificial Sequence: Synthetic polypeptide
  XENP019519 [CTLA-4]_H0_L0.100_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQLGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5285 - protein, 108 aa, Artificial Sequence; identical to SEQ ID NO: 2309
  Description of Artificial Sequence: Synthetic polypeptide
  VL of XENP019519

SEQ ID NO: 5286 - protein, 12 aa, Artificial Sequence
  Description of Artificial Sequence: Synthetic peptide
  XENP019519 vlCDR1
RASQSVGSSYLA

SEQ ID NO: 5287 - protein, 7 aa, Artificial Sequence
  Description of Artificial Sequence: Synthetic peptide
  XENP019519 vlCDR2
GAFSRAT

SEQ ID NO: 5288 - protein, 9 aa, Artificial Sequence
  Description of Artificial Sequence: Synthetic peptide
  XENP019519 vlCDR3
QQLGSSPWT

SEQ ID NO: 5289 - protein, 221 aa, Artificial Sequence; identical to SEQ ID NO: 2919
  Description of Artificial Sequence: Synthetic polypeptide
  XENP019520 [CTLA-4]_H0_L0.101_Fab Heavy Chain

SEQ ID NO: 5290 - protein, 118 aa, Artificial Sequence; identical to SEQ ID NO: 22
  Description of Artificial Sequence: Synthetic polypeptide
  VH of XENP019520

SEQ ID NO: 5291 - protein, 5 aa, Artificial Sequence
  Description of Artificial Sequence: Synthetic peptide
  XENP019520 vhCDR1
SYTMH

SEQ ID NO: 5292 - protein, 17 aa, Artificial Sequence
  Description of Artificial Sequence: Synthetic peptide
  XENP019520 vhCDR2
FISYDGNNKYYADSVKG

SEQ ID NO: 5293 - protein, 9 aa, Artificial Sequence
  Description of Artificial Sequence: Synthetic peptide
  XENP019520 vhCDR3
TGWLGPFDY

SEQ ID NO: 5294 - protein, 215 aa, Artificial Sequence
  Description of Artificial Sequence: Synthetic polypeptide
  XENP019520 [CTLA-4]_H0_L0.101_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQVGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5295 - protein, 108 aa, Artificial Sequence; identical to SEQ ID NO: 2318
  Description of Artificial Sequence: Synthetic polypeptide
  VL of XENP019520

SEQ ID NO: 5296 - protein, 12 aa, Artificial Sequence
  Description of Artificial Sequence: Synthetic peptide
  XENP019520 vlCDR1
RASQSVGSSYLA

SEQ ID NO: 5297 - protein, 7 aa, Artificial Sequence
  Description of Artificial Sequence: Synthetic peptide
  XENP019520 vlCDR2
GAFSRAT

SEQ ID NO: 5298 - protein, 9 aa, Artificial Sequence
  Description of Artificial Sequence: Synthetic peptide
  XENP019520 vlCDR3
QQVGSSPWT

SEQ ID NO: 5299 - protein, 221 aa, Artificial Sequence; identical to SEQ ID NO: 2919
  Description of Artificial Sequence: Synthetic polypeptide
  XENP019521 [CTLA-4]_H0_L0.102_Fab Heavy Chain

SEQ ID NO: 5300 - protein, 118 aa, Artificial Sequence; identical to SEQ ID NO: 22
  Description of Artificial Sequence: Synthetic polypeptide
  VH of XENP019521

SEQ ID NO: 5301 - protein, 5 aa, Artificial Sequence
  Description of Artificial Sequence: Synthetic peptide
  XENP019521 vhCDR1
SYTMH

SEQ ID NO: 5302 - protein, 17 aa, Artificial Sequence
  Description of Artificial Sequence: Synthetic peptide
  XENP019521 vhCDR2
FISYDGNNKYYADSVKG

SEQ ID NO: 5303 - protein, 9 aa, Artificial Sequence
  Description of Artificial Sequence: Synthetic peptide
  XENP019521 vhCDR3
TGWLGPFDY

SEQ ID NO: 5304 - protein, 215 aa, Artificial Sequence
  Description of Artificial Sequence: Synthetic polypeptide
  XENP019521 [CTLA-4]_H0_L0.102_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQYGESPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5305 - protein, 108 aa, Artificial Sequence; identical to SEQ ID NO: 2327
  Description of Artificial Sequence: Synthetic polypeptide
  VL of XENP019521

SEQ ID NO: 5306 - protein, 12 aa, Artificial Sequence
  Description of Artificial Sequence: Synthetic peptide
  XENP019521 vlCDR1
RASQSVGSSYLA

SEQ ID NO: 5307 - protein, 7 aa, Artificial Sequence
  Description of Artificial Sequence: Synthetic peptide
  XENP019521 vlCDR2
GAFSRAT

SEQ ID NO: 5308 - protein, 9 aa, Artificial Sequence
  Description of Artificial Sequence: Synthetic peptide
  XENP019521 vlCDR3
QQYGESPWT

SEQ ID NO: 5309 - protein, 221 aa, Artificial Sequence; identical to SEQ ID NO: 2919
  Description of Artificial Sequence: Synthetic polypeptide
  XENP019522 [CTLA-4]_H0_L0.103_Fab Heavy Chain

SEQ ID NO: 5310 - protein, 118 aa, Artificial Sequence; identical to SEQ ID NO: 22
  Description of Artificial Sequence: Synthetic polypeptide
  VH of XENP019522

SEQ ID NO: 5311 - protein, 5 aa, Artificial Sequence
  Description of Artificial Sequence: Synthetic peptide
  XENP019522 vhCDR1
SYTMH

SEQ ID NO: 5312 - protein, 17 aa, Artificial Sequence
  Description of Artificial Sequence: Synthetic peptide
  XENP019522 vhCDR2
FISYDGNNKYYADSVKG

SEQ ID NO: 5313 - protein, 9 aa, Artificial Sequence
  Description of Artificial Sequence: Synthetic peptide
  XENP019522 vhCDR3
TGWLGPFDY

SEQ ID NO: 5314 - protein, 215 aa, Artificial Sequence
  Description of Artificial Sequence: Synthetic polypeptide
  XENP019522 [CTLA-4]_H0_L0.103_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQYGKSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5315 - protein, 108 aa, Artificial Sequence; identical to SEQ ID NO: 2336
  Description of Artificial Sequence: Synthetic polypeptide
  VL of XENP019522

SEQ ID NO: 5316 - protein, 12 aa, Artificial Sequence
  Description of Artificial Sequence: Synthetic peptide
  XENP019522 vlCDR1
RASQSVGSSYLA

SEQ ID NO: 5317 - protein, 7 aa, Artificial Sequence
  Description of Artificial Sequence: Synthetic peptide
  XENP019522 vlCDR2
GAFSRAT

SEQ ID NO: 5318 - protein, 9 aa, Artificial Sequence
  Description of Artificial Sequence: Synthetic peptide
  XENP019522 vlCDR3
QQYGKSPWT

SEQ ID NO: 5319 - protein, 221 aa, Artificial Sequence; identical to SEQ ID NO: 2919
  Description of Artificial Sequence: Synthetic polypeptide
  XENP019523 [CTLA-4]_H0_L0.104_Fab Heavy Chain

SEQ ID NO: 5320 - protein, 118 aa, Artificial Sequence; identical to SEQ ID NO: 22
  Description of Artificial Sequence: Synthetic polypeptide
  VH of XENP019523

SEQ ID NO: 5321 - protein, 5 aa, Artificial Sequence
  Description of Artificial Sequence: Synthetic peptide
  XENP019523 vhCDR1
SYTMH

SEQ ID NO: 5322 - protein, 17 aa, Artificial Sequence
  Description of Artificial Sequence: Synthetic peptide
  XENP019523 vhCDR2
FISYDGNNKYYADSVKG

SEQ ID NO: 5323 - protein, 9 aa, Artificial Sequence
  Description of Artificial Sequence: Synthetic peptide
  XENP019523 vhCDR3
TGWLGPFDY

SEQ ID NO: 5324 - protein, 215 aa, Artificial Sequence
  Description of Artificial Sequence: Synthetic polypeptide
  XENP019523 [CTLA-4]_H0_L0.104_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSYPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5325 - protein, 108 aa, Artificial Sequence; identical to SEQ ID NO: 2345
  Description of Artificial Sequence: Synthetic polypeptide
  VL of XENP019523

SEQ ID NO: 5326 - protein, 12 aa, Artificial Sequence
  Description of Artificial Sequence: Synthetic peptide
  XENP019523 vlCDR1
RASQSVGSSYLA

SEQ ID NO: 5327 - protein, 7 aa, Artificial Sequence
  Description of Artificial Sequence: Synthetic peptide
  XENP019523 vlCDR2
GAFSRAT

SEQ ID NO: 5328 - protein, 9 aa, Artificial Sequence
  Description of Artificial Sequence: Synthetic peptide
  XENP019523 vlCDR3
QQYGSYPWT

SEQ ID NO: 5329 - protein, 221 aa, Artificial Sequence; identical to SEQ ID NO: 2919
  Description of Artificial Sequence: Synthetic polypeptide
  XENP019524 [CTLA-4]_H0_L0.105_Fab Heavy Chain

SEQ ID NO: 5330 - protein, 118 aa, Artificial Sequence; identical to SEQ ID NO: 22
  Description of Artificial Sequence: Synthetic polypeptide
  VH of XENP019524

SEQ ID NO: 5331 - protein, 5 aa, Artificial Sequence
  Description of Artificial Sequence: Synthetic peptide
  XENP019524 vhCDR1
SYTMH

SEQ ID NO: 5332 - protein, 17 aa, Artificial Sequence
  Description of Artificial Sequence: Synthetic peptide
  XENP019524 vhCDR2
FISYDGNNKYYADSVKG

SEQ ID NO: 5333 - protein, 9 aa, Artificial Sequence
  Description of Artificial Sequence: Synthetic peptide
  XENP019524 vhCDR3
TGWLGPFDY

SEQ ID NO: 5334 - protein, 215 aa, Artificial Sequence
  Description of Artificial Sequence: Synthetic polypeptide
  XENP019524 [CTLA-4]_H0_L0.105_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSHWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5335 - protein, 108 aa, Artificial Sequence; identical to SEQ ID NO: 2354
  Description of Artificial Sequence: Synthetic polypeptide
  VL of XENP019524

SEQ ID NO: 5336 - protein, 12 aa, Artificial Sequence
  Description of Artificial Sequence: Synthetic peptide
  XENP019524 vlCDR1
RASQSVGSSYLA

SEQ ID NO: 5337 - protein, 7 aa, Artificial Sequence
  Description of Artificial Sequence: Synthetic peptide
  XENP019524 vlCDR2
GAFSRAT

SEQ ID NO: 5338 - protein, 9 aa, Artificial Sequence
  Description of Artificial Sequence: Synthetic peptide
  XENP019524 vlCDR3
QQYGSSHWT

SEQ ID NO: 5339 - protein, 221 aa, Artificial Sequence; identical to SEQ ID NO: 2919
  Description of Artificial Sequence: Synthetic polypeptide
  XENP019525 [CTLA-4]_H0_L0.106_Fab Heavy Chain

SEQ ID NO: 5340 - protein, 118 aa, Artificial Sequence; identical to SEQ ID NO: 22
  Description of Artificial Sequence: Synthetic polypeptide
  VH of XENP019525

SEQ ID NO: 5341 - protein, 5 aa, Artificial Sequence
  Description of Artificial Sequence: Synthetic peptide
  XENP019525 vhCDR1
SYTMH

SEQ ID NO: 5342 - protein, 17 aa, Artificial Sequence
  Description of Artificial Sequence: Synthetic peptide
  XENP019525 vhCDR2
FISYDGNNKYYADSVKG

SEQ ID NO: 5343 - protein, 9 aa, Artificial Sequence
  Description of Artificial Sequence: Synthetic peptide
  XENP019525 vhCDR3
TGWLGPFDY

SEQ ID NO: 5344 - protein, 215 aa, Artificial Sequence
  Description of Artificial Sequence: Synthetic polypeptide
  XENP019525 [CTLA-4]_H0_L0.106_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5345 - protein, 108 aa, Artificial Sequence; identical to SEQ ID NO: 2363
  Description of Artificial Sequence: Synthetic polypeptide
  VL of XENP019525

SEQ ID NO: 5346 - protein, 12 aa, Artificial Sequence
  Description of Artificial Sequence: Synthetic peptide
  XENP019525 vlCDR1
RASQSVGSSYLA

SEQ ID NO: 5347 - protein, 7 aa, Artificial Sequence
  Description of Artificial Sequence: Synthetic peptide
  XENP019525 vlCDR2
GAFSRAT

SEQ ID NO: 5348 - protein, 9 aa, Artificial Sequence
  Description of Artificial Sequence: Synthetic peptide
  XENP019525 vlCDR3
QQYGSSPFT

SEQ ID NO: 5349 - protein, 221 aa, Artificial Sequence; identical to SEQ ID NO: 2919
  Description of Artificial Sequence: Synthetic polypeptide
  XENP019526 [CTLA-4]_H0_L0.107_Fab Heavy Chain

SEQ ID NO: 5350 - protein, 118 aa, Artificial Sequence; identical to SEQ ID NO: 22
  Description of Artificial Sequence: Synthetic polypeptide
  VH of XENP019526

SEQ ID NO: 5351 - protein, 5 aa, Artificial Sequence
  Description of Artificial Sequence: Synthetic peptide
  XENP019526 vhCDR1
SYTMH

SEQ ID NO: 5352 - protein, 17 aa, Artificial Sequence
  Description of Artificial Sequence: Synthetic peptide
  XENP019526 vhCDR2
FISYDGNNKYYADSVKG

SEQ ID NO: 5353 - protein, 9 aa, Artificial Sequence
  Description of Artificial Sequence: Synthetic peptide
  XENP019526 vhCDR3
TGWLGPFDY

SEQ ID NO: 5354 - protein, 215 aa, Artificial Sequence
  Description of Artificial Sequence: Synthetic polypeptide
  XENP019526 [CTLA-4]_H0_L0.107_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPHTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5355 - protein, 108 aa, Artificial Sequence; identical to SEQ ID NO: 2372
  Description of Artificial Sequence: Synthetic polypeptide
  VL of XENP019526

SEQ ID NO: 5356 - protein, 12 aa, Artificial Sequence
  Description of Artificial Sequence: Synthetic peptide
  XENP019526 vlCDR1
RASQSVGSSYLA

SEQ ID NO: 5357 - protein, 7 aa, Artificial Sequence
  Description of Artificial Sequence: Synthetic peptide
  XENP019526 vlCDR2
GAFSRAT

SEQ ID NO: 5358 - protein, 9 aa, Artificial Sequence
  Description of Artificial Sequence: Synthetic peptide
  XENP019526 vlCDR3
QQYGSSPHT

SEQ ID NO: 5359 - protein, 221 aa, Artificial Sequence; identical to SEQ ID NO: 2919
  Description of Artificial Sequence: Synthetic polypeptide
  XENP019527 [CTLA-4]_H0_L0.108_Fab Heavy Chain

SEQ ID NO: 5360 - protein, 118 aa, Artificial Sequence; identical to SEQ ID NO: 22
  Description of Artificial Sequence: Synthetic polypeptide
  VH of XENP019527

SEQ ID NO: 5361 - protein, 5 aa, Artificial Sequence
  Description of Artificial Sequence: Synthetic peptide
  XENP019527 vhCDR1
SYTMH

SEQ ID NO: 5362 - protein, 17 aa, Artificial Sequence
  Description of Artificial Sequence: Synthetic peptide
  XENP019527 vhCDR2
FISYDGNNKYYADSVKG

SEQ ID NO: 5363 - protein, 9 aa, Artificial Sequence
  Description of Artificial Sequence: Synthetic peptide
  XENP019527 vhCDR3
TGWLGPFDY

SEQ ID NO: 5364 - protein, 215 aa, Artificial Sequence
  Description of Artificial Sequence: Synthetic polypeptide
  XENP019527 [CTLA-4]_H0_L0.108_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPITFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5365 - protein, 108 aa, Artificial Sequence; identical to SEQ ID NO: 2381
  Description of Artificial Sequence: Synthetic polypeptide
  VL of XENP019527

SEQ ID NO: 5366 - protein, 12 aa, Artificial Sequence
  Description of Artificial Sequence: Synthetic peptide
  XENP019527 vlCDR1
RASQSVGSSYLA

SEQ ID NO: 5367 - protein, 7 aa, Artificial Sequence
  Description of Artificial Sequence: Synthetic peptide
  XENP019527 vlCDR2
GAFSRAT

SEQ ID NO: 5368 - protein, 9 aa, Artificial Sequence
  Description of Artificial Sequence: Synthetic peptide
  XENP019527 vlCDR3
QQYGSSPIT

SEQ ID NO: 5369 - protein, 221 aa, Artificial Sequence; identical to SEQ ID NO: 2919
  Description of Artificial Sequence: Synthetic polypeptide
  XENP019528 [CTLA-4]_H0_L0.109_Fab Heavy Chain

SEQ ID NO: 5370 - protein, 118 aa, Artificial Sequence; identical to SEQ ID NO: 22
  Description of Artificial Sequence: Synthetic polypeptide
  VH of XENP019528

SEQ ID NO: 5371 - protein, 5 aa, Artificial Sequence
  Description of Artificial Sequence: Synthetic peptide
  XENP019528 vhCDR1
SYTMH

SEQ ID NO: 5372 - protein, 17 aa, Artificial Sequence
  Description of Artificial Sequence: Synthetic peptide
  XENP019528 vhCDR2
FISYDGNNKYYADSVKG

SEQ ID NO: 5373 - protein, 9 aa, Artificial Sequence
  Description of Artificial Sequence: Synthetic peptide
  XENP019528 vhCDR3
TGWLGPFDY

SEQ ID NO: 5374 - protein, 215 aa, Artificial Sequence
  Description of Artificial Sequence: Synthetic polypeptide
  XENP019528 [CTLA-4]_H0_L0.109_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5375 - protein, 108 aa, Artificial Sequence; identical to SEQ ID NO: 2390
  Description of Artificial Sequence: Synthetic polypeptide
  VL of XENP019528

SEQ ID NO: 5376 - protein, 12 aa, Artificial Sequence
  Description of Artificial Sequence: Synthetic peptide
  XENP019528 vlCDR1
RASQSVGSSYLA

SEQ ID NO: 5377 - protein, 7 aa, Artificial Sequence
  Description of Artificial Sequence: Synthetic peptide
  XENP019528 vlCDR2
GAFSRAT

SEQ ID NO: 5378 - protein, 9 aa, Artificial Sequence
  Description of Artificial Sequence: Synthetic peptide
  XENP019528 vlCDR3
QQYGSSPLT

SEQ ID NO: 5379 - protein, 221 aa, Artificial Sequence; identical to SEQ ID NO: 2919
  Description of Artificial Sequence: Synthetic polypeptide
  XENP019529 [CTLA-4]_H0_L0.110_Fab Heavy Chain

SEQ ID NO: 5380 - protein, 118 aa, Artificial Sequence; identical to SEQ ID NO: 22
  Description of Artificial Sequence: Synthetic polypeptide
  VH of XENP019529

SEQ ID NO: 5381 - protein, 5 aa, Artificial Sequence
  Description of Artificial Sequence: Synthetic peptide
  XENP019529 vhCDR1
SYTMH

SEQ ID NO: 5382 - protein, 17 aa, Artificial Sequence
  Description of Artificial Sequence: Synthetic peptide
  XENP019529 vhCDR2
FISYDGNNKYYADSVKG

SEQ ID NO: 5383 - protein, 9 aa, Artificial Sequence
  Description of Artificial Sequence: Synthetic peptide
  XENP019529 vhCDR3
TGWLGPFDY

SEQ ID NO: 5384 - protein, 215 aa, Artificial Sequence
  Description of Artificial Sequence: Synthetic polypeptide
  XENP019529 [CTLA-4]_H0_L0.110_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5385 - protein, 108 aa, Artificial Sequence; identical to SEQ ID NO: 2399
  Description of Artificial Sequence: Synthetic polypeptide
  VL of XENP019529

SEQ ID NO: 5386 - protein, 12 aa, Artificial Sequence
  Description of Artificial Sequence: Synthetic peptide
  XENP019529 vlCDR1
RASQSVGSSYLA

SEQ ID NO: 5387 - protein, 7 aa, Artificial Sequence
  Description of Artificial Sequence: Synthetic peptide
  XENP019529 vlCDR2
GAFSRAT

SEQ ID NO: 5388 - protein, 9 aa, Artificial Sequence
  Description of Artificial Sequence: Synthetic peptide
  XENP019529 vlCDR3
QQYGSSPYT

SEQ ID NO: 5389 - protein, 221 aa, Artificial Sequence; identical to SEQ ID NO: 2919
  Description of Artificial Sequence: Synthetic polypeptide
  XENP019530 [CTLA-4]_H0_L0.111_Fab Heavy Chain

SEQ ID NO: 5390 - protein, 118 aa, Artificial Sequence; identical to SEQ ID NO: 22
  Description of Artificial Sequence: Synthetic polypeptide
  VH of XENP019530

SEQ ID NO: 5391 - protein, 5 aa, Artificial Sequence
  Description of Artificial Sequence: Synthetic peptide
  XENP019530 vhCDR1
SYTMH

SEQ ID NO: 5392 - protein, 17 aa, Artificial Sequence
  Description of Artificial Sequence: Synthetic peptide
  XENP019530 vhCDR2
FISYDGNNKYYADSVKG

SEQ ID NO: 5393 - protein, 9 aa, Artificial Sequence
  Description of Artificial Sequence: Synthetic peptide
  XENP019530 vhCDR3
TGWLGPFDY

SEQ ID NO: 5394 - protein, 215 aa, Artificial Sequence
  Description of Artificial Sequence: Synthetic polypeptide
  XENP019530 [CTLA-4]_H0_L0.111_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWVFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5395 - protein, 108 aa, Artificial Sequence; identical to SEQ ID NO: 2408
  Description of Artificial Sequence: Synthetic polypeptide
  VL of XENP019530

SEQ ID NO: 5396 - protein, 12 aa, Artificial Sequence
  Description of Artificial Sequence: Synthetic peptide
  XENP019530 vlCDR1
RASQSVGSSYLA

SEQ ID NO: 5397 - protein, 7 aa, Artificial Sequence
  Description of Artificial Sequence: Synthetic peptide
  XENP019530 vlCDR2
GAFSRAT

SEQ ID NO: 5398 - protein, 9 aa, Artificial Sequence
  Description of Artificial Sequence: Synthetic peptide
  XENP019530 vlCDR3
QQYGSSPWV

SEQ ID NO: 5399 - protein, 221 aa, Artificial Sequence; identical to SEQ ID NO: 2919
  Description of Artificial Sequence: Synthetic polypeptide
  XENP019531 [CTLA-4]_H0_L0.112_Fab Heavy Chain

SEQ ID NO: 5400 - protein, 118 aa, Artificial Sequence; identical to SEQ ID NO: 22
  Description of Artificial Sequence: Synthetic polypeptide
  VH of XENP019531

SEQ ID NO: 5401 - protein, 5 aa, Artificial Sequence
  Description of Artificial Sequence: Synthetic peptide
  XENP019531 vhCDR1
SYTMH

SEQ ID NO: 5402 - protein, 17 aa, Artificial Sequence
  Description of Artificial Sequence: Synthetic peptide
  XENP019531 vhCDR2
FISYDGNNKYYADSVKG

SEQ ID NO: 5403 - protein, 9 aa, Artificial Sequence
  Description of Artificial Sequence: Synthetic peptide
  XENP019531 vhCDR3
TGWLGPFDY

SEQ ID NO: 5404 - protein, 215 aa, Artificial Sequence
  Description of Artificial Sequence: Synthetic polypeptide
  XENP019531 [CTLA-4]_H0_L0.112_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5405 - protein, 108 aa, Artificial Sequence; identical to SEQ ID NO: 2417
  Description of Artificial Sequence: Synthetic polypeptide
  VL of XENP019531

SEQ ID NO: 5406 - protein, 12 aa, Artificial Sequence
  Description of Artificial Sequence: Synthetic peptide
  XENP019531 vlCDR1
RASQSVGSSYLA

SEQ ID NO: 5407 - protein, 7 aa, Artificial Sequence
  Description of Artificial Sequence: Synthetic peptide
  XENP019531 vlCDR2
GAFSRAT

SEQ ID NO: 5408 - protein, 9 aa, Artificial Sequence
  Description of Artificial Sequence: Synthetic peptide
  XENP019531 vlCDR3
QQYGSSPWT

SEQ ID NO: 5409 - protein, 221 aa, Artificial Sequence; identical to SEQ ID NO: 2919
  Description of Artificial Sequence: Synthetic polypeptide
  XENP019532 [CTLA-4]_H0_L0.113_Fab Heavy Chain

SEQ ID NO: 5410 - protein, 118 aa, Artificial Sequence; identical to SEQ ID NO: 22
  Description of Artificial Sequence: Synthetic polypeptide
  VH of XENP019532

SEQ ID NO: 5411 - protein, 5 aa, Artificial Sequence
  Description of Artificial Sequence: Synthetic peptide
  XENP019532 vhCDR1
SYTMH

SEQ ID NO: 5412 - protein, 17 aa, Artificial Sequence
  Description of Artificial Sequence: Synthetic peptide
  XENP019532 vhCDR2
FISYDGNNKYYADSVKG

SEQ ID NO: 5413 - protein, 9 aa, Artificial Sequence
  Description of Artificial Sequence: Synthetic peptide
  XENP019532 vhCDR3
TGWLGPFDY

SEQ ID NO: 5414 - protein, 215 aa, Artificial Sequence
  Description of Artificial Sequence: Synthetic polypeptide
  XENP019532 [CTLA-4]_H0_L0.113_Fab Light Chain
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGEGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5415 - protein, 108 aa, Artificial Sequence; identical to SEQ ID NO: 59
  Description of Artificial Sequence: Synthetic polypeptide
  VL of XENP019532

SEQ ID NO: 5416 - protein, 12 aa, Artificial Sequence
  Description of Artificial Sequence: Synthetic peptide
  XENP019532 vlCDR1
RASQSVGSSYLA

SEQ ID NO: 5417 - protein, 7 aa, Artificial Sequence
  Description of Artificial Sequence: Synthetic peptide
  XENP019532 vlCDR2
GAFSRAT

SEQ ID NO: 5418 - protein, 9 aa, Artificial Sequence
  Description of Artificial Sequence: Synthetic peptide
  XENP019532 vlCDR3
QQYGSSPWT

SEQ ID NO: 5419 - protein, 221 aa, Artificial Sequence
  Description of Artificial Sequence: Synthetic polypeptide
  XENP019544 [CTLA-4]_H1_L0_Fab Heavy Chain
EVQLVESGGGLVQPGGSLRLSCAASGFTFSSYTMHWVRQAPGKGLEWVTFISYDGNNKYYVDSVKGRFTISRDNAKNSLYLQMNSLRAEDTAVYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5420 - protein, 118 aa, Artificial Sequence; identical to SEQ ID NO: 121
  Description of Artificial Sequence: Synthetic polypeptide
  VH of XENP019544

SEQ ID NO: 5421 - protein, 5 aa, Artificial Sequence
  Description of Artificial Sequence: Synthetic peptide
  XENP019544 vhCDR1
SYTMH

SEQ ID NO: 5422 - protein, 17 aa, Artificial Sequence
  Description of Artificial Sequence: Synthetic peptide
  XENP019544 vhCDR2
FISYDGNNKYYVDSVKG

SEQ ID NO: 5423 - protein, 9 aa, Artificial Sequence
  Description of Artificial Sequence: Synthetic peptide
  XENP019544 vhCDR3
TGWLGPFDY

SEQ ID NO: 5424 - protein, 215 aa, Artificial Sequence; identical to SEQ ID NO: 2924
  Description of Artificial Sequence: Synthetic polypeptide
  XENP019544 [CTLA-4]_H1_L0_Fab Light Chain

SEQ ID NO: 5425 - protein, 108 aa, Artificial Sequence; identical to SEQ ID NO: 23
  Description of Artificial Sequence: Synthetic polypeptide
  VL of XENP019544

SEQ ID NO: 5426 - protein, 12 aa, Artificial Sequence
  Description of Artificial Sequence: Synthetic peptide
  XENP019544 vlCDR1
RASQSVGSSYLA

SEQ ID NO: 5427 - protein, 7 aa, Artificial Sequence
  Description of Artificial Sequence: Synthetic peptide
  XENP019544 vlCDR2
GAFSRAT

SEQ ID NO: 5428 - protein, 9 aa, Artificial Sequence
  Description of Artificial Sequence: Synthetic peptide
  XENP019544 vlCDR3
QQYGSSPWT

SEQ ID NO: 5429 - protein, 221 aa, Artificial Sequence
  Description of Artificial Sequence: Synthetic polypeptide
  XENP019545 [CTLA-4]_H2_L0_Fab Heavy Chain
EVQLVESGGGLVQPGGSLRLSCAASGFTFSSYTMHWVRQAPGKGLEWVTFISYDGNNKYYPGSVKGRFTISRENAKNSLYLQMNSLRAGDTAVYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5430 - protein, 118 aa, Artificial Sequence; identical to SEQ ID NO: 130
  Description of Artificial Sequence: Synthetic polypeptide
  VH of XENP019545

SEQ ID NO: 5431 - protein, 5 aa, Artificial Sequence
  Description of Artificial Sequence: Synthetic peptide
  XENP019545 vhCDR1
SYTMH

SEQ ID NO: 5432 - protein, 17 aa, Artificial Sequence
  Description of Artificial Sequence: Synthetic peptide
  XENP019545 vhCDR2
FISYDGNNKYYPGSVKG

SEQ ID NO: 5433 - protein, 9 aa, Artificial Sequence
  Description of Artificial Sequence: Synthetic peptide
  XENP019545 vhCDR3
TGWLGPFDY

SEQ ID NO: 5434 - protein, 215 aa, Artificial Sequence; identical to SEQ ID NO: 2924
  Description of Artificial Sequence: Synthetic polypeptide
  XENP019545 [CTLA-4]_H2_L0_Fab Light Chain

SEQ ID NO: 5435 - protein, 108 aa, Artificial Sequence; identical to SEQ ID NO: 23
  Description of Artificial Sequence: Synthetic polypeptide
  VL of XENP019545

SEQ ID NO: 5436 - protein, 12 aa, Artificial Sequence
  Description of Artificial Sequence: Synthetic peptide
  XENP019545 vlCDR1
RASQSVGSSYLA

SEQ ID NO: 5437 - protein, 7 aa, Artificial Sequence
  Description of Artificial Sequence: Synthetic peptide
  XENP019545 vlCDR2
GAFSRAT

SEQ ID NO: 5438 - protein, 9 aa, Artificial Sequence
  Description of Artificial Sequence: Synthetic peptide
  XENP019545 vlCDR3
QQYGSSPWT

SEQ ID NO: 5439 - protein, 221 aa, Artificial Sequence
  Description of Artificial Sequence: Synthetic polypeptide
  XENP019546 [CTLA-4]_H3_L0_Fab Heavy Chain
EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5440 - protein, 118 aa, Artificial Sequence; identical to SEQ ID NO: 139
  Description of Artificial Sequence: Synthetic polypeptide
  VH of XENP019546

SEQ ID NO: 5441 - protein, 5 aa, Artificial Sequence
  Description of Artificial Sequence: Synthetic peptide
  XENP019546 vhCDR1
SYTMH

SEQ ID NO: 5442 - protein, 17 aa, Artificial Sequence
  Description of Artificial Sequence: Synthetic peptide
  XENP019546 vhCDR2
FISYDGNNKYYADSVKG

SEQ ID NO: 5443 - protein, 9 aa, Artificial Sequence
  Description of Artificial Sequence: Synthetic peptide
  XENP019546 vhCDR3
TGWLGPFDY

SEQ ID NO: 5444 - protein, 215 aa, Artificial Sequence; identical to SEQ ID NO: 2924
  Description of Artificial Sequence: Synthetic polypeptide
  XENP019546 [CTLA-4]_H3_L0_Fab Light Chain

SEQ ID NO: 5445 - protein, 108 aa, Artificial Sequence; identical to SEQ ID NO: 23
  Description of Artificial Sequence: Synthetic polypeptide
  VL of XENP019546

SEQ ID NO: 5446 - protein, 12 aa, Artificial Sequence
  Description of Artificial Sequence: Synthetic peptide
  XENP019546 vlCDR1
RASQSVGSSYLA

SEQ ID NO: 5447 - protein, 7 aa, Artificial Sequence
  Description of Artificial Sequence: Synthetic peptide
  XENP019546 vlCDR2
GAFSRAT

SEQ ID NO: 5448 - protein, 9 aa, Artificial Sequence
  Description of Artificial Sequence: Synthetic peptide
  XENP019546 vlCDR3
QQYGSSPWT

SEQ ID NO: 5449 - protein, 221 aa, Artificial Sequence
  Description of Artificial Sequence: Synthetic polypeptide
  XENP019547 [CTLA-4]_H4_L0_Fab Heavy Chain
EVQLVESGGGLVQPGGSLRLSCAASGFTFSSYTMHWVRQAPGKGLEYVTFISYDGNNKYYADSVKGRFTISRDNSKNTLYLQMGSLRAEDMAVYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5450 - protein, 118 aa, Artificial Sequence; identical to SEQ ID NO: 148
  Description of Artificial Sequence: Synthetic polypeptide
  VH of XENP019547

SEQ ID NO: 5451 - protein, 5 aa, Artificial Sequence
  Description of Artificial Sequence: Synthetic peptide
  XENP019547 vhCDR1
SYTMH

SEQ ID NO: 5452 - protein, 17 aa, Artificial Sequence
  Description of Artificial Sequence: Synthetic peptide
  XENP019547 vhCDR2
FISYDGNNKYYADSVKG

SEQ ID NO: 5453 - protein, 9 aa, Artificial Sequence
  Description of Artificial Sequence: Synthetic peptide
  XENP019547 vhCDR3
TGWLGPFDY

SEQ ID NO: 5454 - protein, 215 aa, Artificial Sequence; identical to SEQ ID NO: 2924
  Description of Artificial Sequence: Synthetic polypeptide
  XENP019547 [CTLA-4]_H4_L0_Fab Light Chain

SEQ ID NO: 5455 - protein, 108 aa, Artificial Sequence; identical to SEQ ID NO: 23
  Description of Artificial Sequence: Synthetic polypeptide
  VL of XENP019547

SEQ ID NO: 5456 - protein, 12 aa, Artificial Sequence
  Description of Artificial Sequence: Synthetic peptide
  XENP019547 vlCDR1
RASQSVGSSYLA

SEQ ID NO: 5457 - protein, 7 aa, Artificial Sequence
  Description of Artificial Sequence: Synthetic peptide
  XENP019547 vlCDR2
GAFSRAT

SEQ ID NO: 5458 - protein, 9 aa, Artificial Sequence
  Description of Artificial Sequence: Synthetic peptide
  XENP019547 vlCDR3
QQYGSSPWT

SEQ ID NO: 5459 - protein, 221 aa, Artificial Sequence; identical to SEQ ID NO: 2919
  Description of Artificial Sequence: Synthetic polypeptide
  XENP019548 [CTLA-4]_H0_L1_Fab Heavy Chain

SEQ ID NO: 5460 - protein, 118 aa, Artificial Sequence; identical to SEQ ID NO: 22
  Description of Artificial Sequence: Synthetic polypeptide
  VH of XENP019548

SEQ ID NO: 5461 - protein, 5 aa, Artificial Sequence
  Description of Artificial Sequence: Synthetic peptide
  XENP019548 vhCDR1
SYTMH

SEQ ID NO: 5462 - protein, 17 aa, Artificial Sequence
  Description of Artificial Sequence: Synthetic peptide
  XENP019548 vhCDR2
FISYDGNNKYYADSVKG

SEQ ID NO: 5463 - protein, 9 aa, Artificial Sequence
  Description of Artificial Sequence: Synthetic peptide
  XENP019548 vhCDR3
TGWLGPFDY

SEQ ID NO: 5464 - protein, 215 aa, Artificial Sequence
  Description of Artificial Sequence: Synthetic polypeptide
  XENP019548 [CTLA-4]_H0_L1_Fab Light Chain
EIVLTQSPATLSLSPGERATLSCGASQSVGSSYLAWYQQKPGLAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5465 - protein, 108 aa, Artificial Sequence; identical to SEQ ID NO: 158
  Description of Artificial Sequence: Synthetic polypeptide
  VL of XENP019548

SEQ ID NO: 5466 - protein, 12 aa, Artificial Sequence
  Description of Artificial Sequence: Synthetic peptide
  XENP019548 vlCDR1
GASQSVGSSYLA

SEQ ID NO: 5467 - protein, 7 aa, Artificial Sequence
  Description of Artificial Sequence: Synthetic peptide
  XENP019548 vlCDR2
GAFSRAT

SEQ ID NO: 5468 - protein, 9 aa, Artificial Sequence
  Description of Artificial Sequence: Synthetic peptide
  XENP019548 vlCDR3
QQYGSSPWT

SEQ ID NO: 5469 - protein, 221 aa, Artificial Sequence; identical to SEQ ID NO: 2919
  Description of Artificial Sequence: Synthetic polypeptide
  XENP019549 [CTLA-4]_H0_L2_Fab Heavy Chain

SEQ ID NO: 5470 - protein, 118 aa, Artificial Sequence; identical to SEQ ID NO: 22
  Description of Artificial Sequence: Synthetic polypeptide
  VH of XENP019549

SEQ ID NO: 5471 - protein, 5 aa, Artificial Sequence
  Description of Artificial Sequence: Synthetic peptide
  XENP019549 vhCDR1
SYTMH

SEQ ID NO: 5472 - protein, 17 aa, Artificial Sequence
  Description of Artificial Sequence: Synthetic peptide
  XENP019549 vhCDR2
FISYDGNNKYYADSVKG

SEQ ID NO: 5473 - protein, 9 aa, Artificial Sequence
  Description of Artificial Sequence: Synthetic peptide
  XENP019549 vhCDR3
TGWLGPFDY

SEQ ID NO: 5474 - protein, 215 aa, Artificial Sequence
  Description of Artificial Sequence: Synthetic polypeptide
  XENP019549 [CTLA-4]_H0_L2_Fab Light Chain
EIVMTQSPATLSVSPGERATLSCRASQSVGSSYLAWYQQKPGQAPRLLIYGAFSRATGIPARFSGSGSGTEFTLTISSLQSEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5475 - protein, 108 aa, Artificial Sequence; identical to SEQ ID NO: 167
  Description of Artificial Sequence: Synthetic polypeptide
  VL of XENP019549

SEQ ID NO: 5476 - protein, 12 aa, Artificial Sequence
  Description of Artificial Sequence: Synthetic peptide
  XENP019549 vlCDR1
RASQSVGSSYLA

SEQ ID NO: 5477 - protein, 7 aa, Artificial Sequence
  Description of Artificial Sequence: Synthetic peptide
  XENP019549 vlCDR2
GAFSRAT

SEQ ID NO: 5478 - protein, 9 aa, Artificial Sequence
  Description of Artificial Sequence: Synthetic peptide
  XENP019549 vlCDR3
QQYGSSPWT

SEQ ID NO: 5479 - protein, 221 aa, Artificial Sequence
  Description of Artificial Sequence: Synthetic polypeptide
  XENP019585 [CTLA-4]_H0.140_L0_Fab Heavy Chain
QVQLVESGGGVVQPGRSLRLSCAASGFTFSSYTMHWVRQAPGKGLEWVCFISYDGNNKYYADSVKGRFTCSRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5480 - protein, 118 aa, Artificial Sequence; identical to SEQ ID NO: 175
  Description of Artificial Sequence: Synthetic polypeptide
  VH of XENP019585

SEQ ID NO: 5481 - protein, 5 aa, Artificial Sequence
  Description of Artificial Sequence: Synthetic peptide
  XENP019585 vhCDR1
SYTMH

SEQ ID NO: 5482 - protein, 17 aa, Artificial Sequence
  Description of Artificial Sequence: Synthetic peptide
  XENP019585 vhCDR2
FISYDGNNKYYADSVKG

SEQ ID NO: 5483 - protein, 9 aa, Artificial Sequence
  Description of Artificial Sequence: Synthetic peptide
  XENP019585 vhCDR3
TGWLGPFDY

SEQ ID NO: 5484 - protein, 215 aa, Artificial Sequence; identical to SEQ ID NO: 2924
  Description of Artificial Sequence: Synthetic polypeptide
  XENP019585 [CTLA-4]_H0.140_L0_Fab Light Chain

SEQ ID NO: 5485 - protein, 108 aa, Artificial Sequence; identical to SEQ ID NO: 23
  Description of Artificial Sequence: Synthetic polypeptide
  VL of XENP019585

SEQ ID NO: 5486 - protein, 12 aa, Artificial Sequence
  Description of Artificial Sequence: Synthetic peptide
  XENP019585 vlCDR1
RASQSVGSSYLA

SEQ ID NO: 5487 - protein, 7 aa, Artificial Sequence
  Description of Artificial Sequence: Synthetic peptide
  XENP019585 vlCDR2
GAFSRAT

SEQ ID NO: 5488 - protein, 9 aa, Artificial Sequence
  Description of Artificial Sequence: Synthetic peptide
  XENP019585 vlCDR3
QQYGSSPWT

SEQ ID NO: 5489 - protein, 221 aa, Artificial Sequence; identical to SEQ ID NO: 2919
  Description of Artificial Sequence: Synthetic polypeptide
  XENP019586 [CTLA-4]_H0_L0.117_Fab Heavy Chain

SEQ ID NO: 5490 - protein, 118 aa, Artificial Sequence; identical to SEQ ID NO: 22
  Description of Artificial Sequence: Synthetic polypeptide
  VH of XENP019586

SEQ ID NO: 5491 - protein, 5 aa, Artificial Sequence
  Description of Artificial Sequence: Synthetic peptide
  XENP019586 vhCDR1
SYTMH

SEQ ID NO: 5492 - protein, 17 aa, Artificial Sequence
  Description of Artificial Sequence: Synthetic peptide
  XENP019586 vhCDR2
FISYDGNNKYYADSVKG

SEQ ID NO: 5493 - protein, 9 aa, Artificial Sequence
  Description of Artificial Sequence: Synthetic peptide
  XENP019586 vhCDR3
TGWLGPFDY

SEQ ID NO: 5494 - protein, 215 aa, Artificial Sequence
  Description of Artificial Sequence: Synthetic polypeptide
  XENP019586 [CTLA-4]_H0_L0.117_Fab Light Chain
EIVLTQSPGTLSLSPGERATLSCRASQSVGSSYLAWYQQKPGQAPRLLCYGAFSRATGIPDRFSCSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5495 - protein, 108 aa, Artificial Sequence; identical to SEQ ID NO: 185
  Description of Artificial Sequence: Synthetic polypeptide
  VL of XENP019586

SEQ ID NO: 5496 - protein, 12 aa, Artificial Sequence
  Description of Artificial Sequence: Synthetic peptide
  XENP019586 vlCDR1
RASQSVGSSYLA

SEQ ID NO: 5497 - protein, 7 aa, Artificial Sequence
  Description of Artificial Sequence: Synthetic peptide
  XENP019586 vlCDR2
GAFSRAT

SEQ ID NO: 5498 - protein, 9 aa, Artificial Sequence
  Description of Artificial Sequence: Synthetic peptide
  XENP019586 vlCDR3
QQYGSSPWT

SEQ ID NO: 5499 - protein, 221 aa, Artificial Sequence; identical to SEQ ID NO: 4259
  Description of Artificial Sequence: Synthetic polypeptide
  XENP020006 [CTLA-4]_H0.134_L0.53_Fab Heavy Chain

SEQ ID NO: 5500 - protein, 118 aa, Artificial Sequence; identical to SEQ ID NO: 67
  Description of Artificial Sequence: Synthetic polypeptide
  VH of XENP020006

SEQ ID NO: 5501 - protein, 5 aa, Artificial Sequence
  Description of Artificial Sequence: Synthetic peptide
  XENP020006 vhCDR1
SYTMH

SEQ ID NO: 5502 - protein, 17 aa, Artificial Sequence
  Description of Artificial Sequence: Synthetic peptide
  XENP020006 vhCDR2
FISYDGNNKYYADSVKG

SEQ ID NO: 5503 - protein, 9 aa, Artificial Sequence
  Description of Artificial Sequence: Synthetic peptide
  XENP020006 vhCDR3
TGWLGPFDY

SEQ ID NO: 5504 - protein, 215 aa, Artificial Sequence; identical to SEQ ID NO: 4814
  Description of Artificial Sequence: Synthetic polypeptide
  XENP020006 [CTLA-4]_H0.134_L0.53_Fab Light Chain

SEQ ID NO: 5505 - protein, 108 aa, Artificial Sequence; identical to SEQ ID NO: 77
  Description of Artificial Sequence: Synthetic polypeptide
  VL of XENP020006

SEQ ID NO: 5506 - protein, 12 aa, Artificial Sequence
  Description of Artificial Sequence: Synthetic peptide
  XENP020006 vlCDR1
RASQSVGSSYLA

SEQ ID NO: 5507 - protein, 7 aa, Artificial Sequence
  Description of Artificial Sequence: Synthetic peptide
  XENP020006 vlCDR2
GAFSRAT

SEQ ID NO: 5508 - protein, 9 aa, Artificial Sequence
  Description of Artificial Sequence: Synthetic peptide
  XENP020006 vlCDR3
QQYGSSPWT

SEQ ID NO: 5509 - protein, 221 aa, Artificial Sequence; identical to SEQ ID NO: 5439
  Description of Artificial Sequence: Synthetic polypeptide
  XENP020007 [CTLA-4]_H3_L1_Fab Heavy Chain

SEQ ID NO: 5510 - protein, 118 aa, Artificial Sequence; identical to SEQ ID NO: 139
  Description of Artificial Sequence: Synthetic polypeptide
  VH of XENP020007

SEQ ID NO: 5511 - protein, 5 aa, Artificial Sequence
  Description of Artificial Sequence: Synthetic peptide
  XENP020007 vhCDR1
SYTMH

SEQ ID NO: 5512 - protein, 17 aa, Artificial Sequence
  Description of Artificial Sequence: Synthetic peptide
  XENP020007 vhCDR2
FISYDGNNKYYADSVKG

SEQ ID NO: 5513 - protein, 9 aa, Artificial Sequence
  Description of Artificial Sequence: Synthetic peptide
  XENP020007 vhCDR3
TGWLGPFDY

SEQ ID NO: 5514 - protein, 215 aa, Artificial Sequence; identical to SEQ ID NO: 5464
  Description of Artificial Sequence: Synthetic polypeptide
  XENP020007 [CTLA-4]_H3_L1_Fab Light Chain

SEQ ID NO: 5515 - protein, 108 aa, Artificial Sequence; identical to SEQ ID NO: 158
  Description of Artificial Sequence: Synthetic polypeptide
  VL of XENP020007

SEQ ID NO: 5516 - protein, 12 aa, Artificial Sequence
  Description of Artificial Sequence: Synthetic peptide
  XENP020007 vlCDR1
GASQSVGSSYLA

SEQ ID NO: 5517 - protein, 7 aa, Artificial Sequence
  Description of Artificial Sequence: Synthetic peptide
  XENP020007 vlCDR2
GAFSRAT

SEQ ID NO: 5518 - protein, 9 aa, Artificial Sequence
  Description of Artificial Sequence: Synthetic peptide
  XENP020007 vlCDR3
QQYGSSPWT

SEQ ID NO: 5519 - protein, 221 aa, Artificial Sequence; identical to SEQ ID NO: 5439
  Description of Artificial Sequence: Synthetic polypeptide
  XENP020008 [CTLA-4]_H3_L2_Fab Heavy Chain

SEQ ID NO: 5520 - protein, 118 aa, Artificial Sequence; identical to SEQ ID NO: 139
  Description of Artificial Sequence: Synthetic polypeptide
  VH of XENP020008

SEQ ID NO: 5521 - protein, 5 aa, Artificial Sequence
  Description of Artificial Sequence: Synthetic peptide
  XENP020008 vhCDR1
SYTMH

SEQ ID NO: 5522 - protein, 17 aa, Artificial Sequence
  Description of Artificial Sequence: Synthetic peptide
  XENP020008 vhCDR2
FISYDGNNKYYADSVKG

SEQ ID NO: 5523 - protein, 9 aa, Artificial Sequence
  Description of Artificial Sequence: Synthetic peptide
  XENP020008 vhCDR3
TGWLGPFDY

SEQ ID NO: 5524 - protein, 215 aa, Artificial Sequence; identical to SEQ ID NO: 5474
  Description of Artificial Sequence: Synthetic polypeptide
  XENP020008 [CTLA-4]_H3_L2_Fab Light Chain

SEQ ID NO: 5525 - protein, 108 aa, Artificial Sequence; identical to SEQ ID NO: 167
  Description of Artificial Sequence: Synthetic polypeptide
  VL of XENP020008

SEQ ID NO: 5526 - protein, 12 aa, Artificial Sequence
  Description of Artificial Sequence: Synthetic peptide
  XENP020008 vlCDR1
RASQSVGSSYLA

SEQ ID NO: 5527 - protein, 7 aa, Artificial Sequence
  Description of Artificial Sequence: Synthetic peptide
  XENP020008 vlCDR2
GAFSRAT

SEQ ID NO: 5528 - protein, 9 aa, Artificial Sequence
  Description of Artificial Sequence: Synthetic peptide
  XENP020008 vlCDR3
QQYGSSPWT

SEQ ID NO: 5529 - protein, 221 aa, Artificial Sequence; identical to SEQ ID NO: 5439
  Description of Artificial Sequence: Synthetic polypeptide
  XENP020009 [CTLA-4]_H3_L0.12_Fab Heavy Chain

SEQ ID NO: 5530 - protein, 118 aa, Artificial Sequence; identical to SEQ ID NO: 139
  Description of Artificial Sequence: Synthetic polypeptide
  VH of XENP020009

SEQ ID NO: 5531 - protein, 5 aa, Artificial Sequence
  Description of Artificial Sequence: Synthetic peptide
  XENP020009 vhCDR1
SYTMH

SEQ ID NO: 5532 - protein, 17 aa, Artificial Sequence
  Description of Artificial Sequence: Synthetic peptide
  XENP020009 vhCDR2
FISYDGNNKYYADSVKG

SEQ ID NO: 5533 - protein, 9 aa, Artificial Sequence
  Description of Artificial Sequence: Synthetic peptide
  XENP020009 vhCDR3
TGWLGPFDY

SEQ ID NO: 5534 - protein, 215 aa, Artificial Sequence; identical to SEQ ID NO: 4404
  Description of Artificial Sequence: Synthetic polypeptide
  XENP020009 [CTLA-4]_H3_L0.12_Fab Light Chain

SEQ ID NO: 5535 - protein, 108 aa, Artificial Sequence; identical to SEQ ID NO: 1517
  Description of Artificial Sequence: Synthetic polypeptide
  VL of XENP020009

SEQ ID NO: 5536 - protein, 12 aa, Artificial Sequence
  Description of Artificial Sequence: Synthetic peptide
  XENP020009 vlCDR1
RASQSVGSSYLA

SEQ ID NO: 5537 - protein, 7 aa, Artificial Sequence
  Description of Artificial Sequence: Synthetic peptide
  XENP020009 vlCDR2
GAFSRAT

SEQ ID NO: 5538 - protein, 9 aa, Artificial Sequence
  Description of Artificial Sequence: Synthetic peptide
  XENP020009 vlCDR3
QQYGSSPWT

SEQ ID NO: 5539 - protein, 221 aa, Artificial Sequence; identical to SEQ ID NO: 5439
  Description of Artificial Sequence: Synthetic polypeptide
  XENP020010 [CTLA-4]_H3_L0.18_Fab Heavy Chain

SEQ ID NO: 5540 - protein, 118 aa, Artificial Sequence; identical to SEQ ID NO: 139
  Description of Artificial Sequence: Synthetic polypeptide
  VH of XENP020010

SEQ ID NO: 5541 - protein, 5 aa, Artificial Sequence
  Description of Artificial Sequence: Synthetic peptide
  XENP020010 vhCDR1
SYTMH

SEQ ID NO: 5542 - protein, 17 aa, Artificial Sequence
  Description of Artificial Sequence: Synthetic peptide
  XENP020010 vhCDR2
FISYDGNNKYYADSVKG

SEQ ID NO: 5543 - protein, 9 aa, Artificial Sequence
  Description of Artificial Sequence: Synthetic peptide
  XENP020010 vhCDR3
TGWLGPFDY

SEQ ID NO: 5544 - protein, 215 aa, Artificial Sequence; identical to SEQ ID NO: 4464
  Description of Artificial Sequence: Synthetic polypeptide
  XENP020010 [CTLA-4]_H3_L0.18_Fab Light Chain

SEQ ID NO: 5545 - protein, 108 aa, Artificial Sequence; identical to SEQ ID NO: 1571
  Description of Artificial Sequence: Synthetic polypeptide
  VL of XENP020010

SEQ ID NO: 5546 - protein, 12 aa, Artificial Sequence
  Description of Artificial Sequence: Synthetic peptide
  XENP020010 vlCDR1
RSSQSVGSSYLA

SEQ ID NO: 5547 - protein, 7 aa, Artificial Sequence
  Description of Artificial Sequence: Synthetic peptide
  XENP020010 vlCDR2
GAFSRAT

SEQ ID NO: 5548 - protein, 9 aa, Artificial Sequence
  Description of Artificial Sequence: Synthetic peptide
  XENP020010 vlCDR3
QQYGSSPWT

SEQ ID NO: 5549 - protein, 221 aa, Artificial Sequence; identical to SEQ ID NO: 5439
  Description of Artificial Sequence: Synthetic polypeptide
  XENP020011 [CTLA-4]_H3_L0.22_Fab Heavy Chain

SEQ ID NO: 5550 - protein, 118 aa, Artificial Sequence; identical to SEQ ID NO: 139
  Description of Artificial Sequence: Synthetic polypeptide
  VH of XENP020011

SEQ ID NO: 5551 - protein, 5 aa, Artificial Sequence
  Description of Artificial Sequence: Synthetic peptide
  XENP020011 vhCDR1
SYTMH

SEQ ID NO: 5552 - protein, 17 aa, Artificial Sequence
  Description of Artificial Sequence: Synthetic peptide
  XENP020011 vhCDR2
FISYDGNNKYYADSVKG

SEQ ID NO: 5553 - protein, 9 aa, Artificial Sequence
  Description of Artificial Sequence: Synthetic peptide
  XENP020011 vhCDR3
TGWLGPFDY

SEQ ID NO: 5554 - protein, 215 aa, Artificial Sequence; identical to SEQ ID NO: 4504
  Description of Artificial Sequence: Synthetic polypeptide
  XENP020011 [CTLA-4]_H3_L0.22_Fab Light Chain

SEQ ID NO: 5555 - protein, 108 aa, Artificial Sequence; identical to SEQ ID NO: 1607
  Description of Artificial Sequence: Synthetic polypeptide
  VL of XENP020011

SEQ ID NO: 5556 - protein, 12 aa, Artificial Sequence
  Description of Artificial Sequence: Synthetic peptide
  XENP020011 vlCDR1
RASQSVSSSYLA

SEQ ID NO: 5557 - protein, 7 aa, Artificial Sequence
  Description of Artificial Sequence: Synthetic peptide
  XENP020011 vlCDR2
GAFSRAT

SEQ ID NO: 5558 - protein, 9 aa, Artificial Sequence
  Description of Artificial Sequence: Synthetic peptide
  XENP020011 vlCDR3
QQYGSSPWT

SEQ ID NO: 5559 - protein, 221 aa, Artificial Sequence; identical to SEQ ID NO: 5439
  Description of Artificial Sequence: Synthetic polypeptide
  XENP020012 [CTLA-4]_H3_L0.27_Fab Heavy Chain

SEQ ID NO: 5560 - protein, 118 aa, Artificial Sequence; identical to SEQ ID NO: 139
  Description of Artificial Sequence: Synthetic polypeptide
  VH of XENP020012

SEQ ID NO: 5561 - protein, 5 aa, Artificial Sequence
  Description of Artificial Sequence: Synthetic peptide
  XENP020012 vhCDR1
SYTMH

SEQ ID NO: 5562 - protein, 17 aa, Artificial Sequence
  Description of Artificial Sequence: Synthetic peptide
  XENP020012 vhCDR2
FISYDGNNKYYADSVKG

SEQ ID NO: 5563 - protein, 9 aa, Artificial Sequence
  Description of Artificial Sequence: Synthetic peptide
  XENP020012 vhCDR3
TGWLGPFDY

SEQ ID NO: 5564 - protein, 215 aa, Artificial Sequence; identical to SEQ ID NO: 4554
  Description of Artificial Sequence: Synthetic polypeptide
  XENP020012 [CTLA-4]_H3_L0.27_Fab Light Chain

SEQ ID NO: 5565 - protein, 108 aa, Artificial Sequence; identical to SEQ ID NO: 1652
  Description of Artificial Sequence: Synthetic polypeptide
  VL of XENP020012

SEQ ID NO: 5566 - protein, 12 aa, Artificial Sequence
  Description of Artificial Sequence: Synthetic peptide
  XENP020012 vlCDR1
RASQSVGQSYLA

SEQ ID NO: 5567 - protein, 7 aa, Artificial Sequence
  Description of Artificial Sequence: Synthetic peptide
  XENP020012 vlCDR2
GAFSRAT

SEQ ID NO: 5568 - protein, 9 aa, Artificial Sequence
  Description of Artificial Sequence: Synthetic peptide
  XENP020012 vlCDR3
QQYGSSPWT

SEQ ID NO: 5569 - protein, 221 aa, Artificial Sequence; identical to SEQ ID NO: 5439
  Description of Artificial Sequence: Synthetic polypeptide
  XENP020013 [CTLA-4]_H3_L0.32_Fab Heavy Chain

SEQ ID NO: 5570 - protein, 118 aa, Artificial Sequence; identical to SEQ ID NO: 139
  Description of Artificial Sequence: Synthetic polypeptide
  VH of XENP020013

SEQ ID NO: 5571 - protein, 5 aa, Artificial Sequence
  Description of Artificial Sequence: Synthetic peptide
  XENP020013 vhCDR1
SYTMH

SEQ ID NO: 5572 - protein, 17 aa, Artificial Sequence
  Description of Artificial Sequence: Synthetic peptide
  XENP020013 vhCDR2
FISYDGNNKYYADSVKG

SEQ ID NO: 5573 - protein, 9 aa, Artificial Sequence
  Description of Artificial Sequence: Synthetic peptide
  XENP020013 vhCDR3
TGWLGPFDY

SEQ ID NO: 5574 - protein, 215 aa, Artificial Sequence; identical to SEQ ID NO: 4604
  Description of Artificial Sequence: Synthetic polypeptide
  XENP020013 [CTLA-4]_H3_L0.32_Fab Light Chain

SEQ ID NO: 5575 - protein, 108 aa, Artificial Sequence; identical to SEQ ID NO: 1697
  Description of Artificial Sequence: Synthetic polypeptide
  VL of XENP020013

SEQ ID NO: 5576 - protein, 12 aa, Artificial Sequence
  Description of Artificial Sequence: Synthetic peptide
  XENP020013 vlCDR1
RASQSVGSQYLA

SEQ ID NO: 5577 - protein, 7 aa, Artificial Sequence
  Description of Artificial Sequence: Synthetic peptide
  XENP020013 vlCDR2
GAFSRAT

SEQ ID NO: 5578 - protein, 9 aa, Artificial Sequence
  Description of Artificial Sequence: Synthetic peptide
  XENP020013 vlCDR3
QQYGSSPWT

SEQ ID NO: 5579 - protein, 221 aa, Artificial Sequence; identical to SEQ ID NO: 5439
  Description of Artificial Sequence: Synthetic polypeptide
  XENP020014 [CTLA-4]_H3_L0.36_Fab Heavy Chain

SEQ ID NO: 5580 - protein, 118 aa, Artificial Sequence; identical to SEQ ID NO: 139
  Description of Artificial Sequence: Synthetic polypeptide
  VH of XENP020014

SEQ ID NO: 5581 - protein, 5 aa, Artificial Sequence
  Description of Artificial Sequence: Synthetic peptide
  XENP020014 vhCDR1
SYTMH

SEQ ID NO: 5582 - protein, 17 aa, Artificial Sequence
  Description of Artificial Sequence: Synthetic peptide
  XENP020014 vhCDR2
FISYDGNNKYYADSVKG

SEQ ID NO: 5583 - protein, 9 aa, Artificial Sequence
  Description of Artificial Sequence: Synthetic peptide
  XENP020014 vhCDR3
TGWLGPFDY

SEQ ID NO: 5584 - protein, 215 aa, Artificial Sequence; identical to SEQ ID NO: 4644
  Description of Artificial Sequence: Synthetic polypeptide
  XENP020014 [CTLA-4]_H3_L0.36_Fab Light Chain

SEQ ID NO: 5585 - protein, 108 aa, Artificial Sequence; identical to SEQ ID NO: 1733
  Description of Artificial Sequence: Synthetic polypeptide
  VL of XENP020014

SEQ ID NO: 5586 - protein, 12 aa, Artificial Sequence
  Description of Artificial Sequence: Synthetic peptide
  XENP020014 vlCDR1
RASQSVGSSHLA

SEQ ID NO: 5587 - protein, 7 aa, Artificial Sequence
  Description of Artificial Sequence: Synthetic peptide
  XENP020014 vlCDR2
GAFSRAT

SEQ ID NO: 5588 - protein, 9 aa, Artificial Sequence
  Description of Artificial Sequence: Synthetic peptide
  XENP020014 vlCDR3
QQYGSSPWT

SEQ ID NO: 5589 - protein, 221 aa, Artificial Sequence; identical to SEQ ID NO: 5439
  Description of Artificial Sequence: Synthetic polypeptide
  XENP020015 [CTLA-4]_H3_L0.37_Fab Heavy Chain

SEQ ID NO: 5590 - protein, 118 aa, Artificial Sequence; identical to SEQ ID NO: 139
  Description of Artificial Sequence: Synthetic polypeptide
  VH of XENP020015

SEQ ID NO: 5591 - protein, 5 aa, Artificial Sequence
  Description of Artificial Sequence: Synthetic peptide
  XENP020015 vhCDR1
SYTMH

SEQ ID NO: 5592 - protein, 17 aa, Artificial Sequence
  Description of Artificial Sequence: Synthetic peptide
  XENP020015 vhCDR2
FISYDGNNKYYADSVKG

SEQ ID NO: 5593 - protein, 9 aa, Artificial Sequence
  Description of Artificial Sequence: Synthetic peptide
  XENP020015 vhCDR3
TGWLGPFDY

SEQ ID NO: 5594 - protein, 215 aa, Artificial Sequence; identical to SEQ ID NO: 4654
  Description of Artificial Sequence: Synthetic polypeptide
  XENP020015 [CTLA-4]_H3_L0.37_Fab Light Chain

SEQ ID NO: 5595 - protein, 108 aa, Artificial Sequence; identical to SEQ ID NO: 1742
  Description of Artificial Sequence: Synthetic polypeptide
  VL of XENP020015

SEQ ID NO: 5596 - protein, 12 aa, Artificial Sequence
  Description of Artificial Sequence: Synthetic peptide
  XENP020015 vlCDR1
RASQSVGSSLLA

SEQ ID NO: 5597 - protein, 7 aa, Artificial Sequence
  Description of Artificial Sequence: Synthetic peptide
  XENP020015 vlCDR2
GAFSRAT

SEQ ID NO: 5598 - protein, 9 aa, Artificial Sequence
  Description of Artificial Sequence: Synthetic peptide
  XENP020015 vlCDR3
QQYGSSPWT

SEQ ID NO: 5599 - protein, 221 aa, Artificial Sequence; identical to SEQ ID NO: 5439
  Description of Artificial Sequence: Synthetic polypeptide
  XENP020016 [CTLA-4]_H3_L0.39_Fab Heavy Chain

SEQ ID NO: 5600 - protein, 118 aa, Artificial Sequence; identical to SEQ ID NO: 139
  Description of Artificial Sequence: Synthetic polypeptide
  VH of XENP020016

SEQ ID NO: 5601 - protein, 5 aa, Artificial Sequence
  Description of Artificial Sequence: Synthetic peptide
  XENP020016 vhCDR1
SYTMH

SEQ ID NO: 5602 - protein, 17 aa, Artificial Sequence
  Description of Artificial Sequence: Synthetic peptide
  XENP020016 vhCDR2
FISYDGNNKYYADSVKG

SEQ ID NO: 5603 - protein, 9 aa, Artificial Sequence
  Description of Artificial Sequence: Synthetic peptide
  XENP020016 vhCDR3
TGWLGPFDY

SEQ ID NO: 5604 - protein, 215 aa, Artificial Sequence; identical to SEQ ID NO: 4674
  Description of Artificial Sequence: Synthetic polypeptide
  XENP020016 [CTLA-4]_H3_L0.39_Fab Light Chain

SEQ ID NO: 5605 - protein, 108 aa, Artificial Sequence; identical to SEQ ID NO: 1760
  Description of Artificial Sequence: Synthetic polypeptide
  VL of XENP020016

SEQ ID NO: 5606 - protein, 12 aa, Artificial Sequence
  Description of Artificial Sequence: Synthetic peptide
  XENP020016 vlCDR1
RASQSVGSSSLA

SEQ ID NO: 5607 - protein, 7 aa, Artificial Sequence
  Description of Artificial Sequence: Synthetic peptide
  XENP020016 vlCDR2
GAFSRAT

SEQ ID NO: 5608 - protein, 9 aa, Artificial Sequence
  Description of Artificial Sequence: Synthetic peptide
  XENP020016 vlCDR3
QQYGSSPWT

SEQ ID NO: 5609 - protein, 221 aa, Artificial Sequence; identical to SEQ ID NO: 5439
  Description of Artificial Sequence: Synthetic polypeptide
  XENP020017 [CTLA-4]_H3_L0.41_Fab Heavy Chain

SEQ ID NO: 5610 - protein, 118 aa, Artificial Sequence; identical to SEQ ID NO: 139
  Description of Artificial Sequence: Synthetic polypeptide
  VH of XENP020017

SEQ ID NO: 5611 - protein, 5 aa, Artificial Sequence
  Description of Artificial Sequence: Synthetic peptide
  XENP020017 vhCDR1
SYTMH

SEQ ID NO: 5612 - protein, 17 aa, Artificial Sequence
  Description of Artificial Sequence: Synthetic peptide
  XENP020017 vhCDR2
FISYDGNNKYYADSVKG

SEQ ID NO: 5613 - protein, 9 aa, Artificial Sequence
  Description of Artificial Sequence: Synthetic peptide
  XENP020017 vhCDR3
TGWLGPFDY

SEQ ID NO: 5614 - protein, 215 aa, Artificial Sequence; identical to SEQ ID NO: 4694
  Description of Artificial Sequence: Synthetic polypeptide
  XENP020017 [CTLA-4]_H3_L0.41_Fab Light Chain

SEQ ID NO: 5615 - protein, 108 aa, Artificial Sequence; identical to SEQ ID NO: 1778
  Description of Artificial Sequence: Synthetic polypeptide
  VL of XENP020017

SEQ ID NO: 5616 - protein, 12 aa, Artificial Sequence
  Description of Artificial Sequence: Synthetic peptide
  XENP020017 vlCDR1
RASQSVGSSYMA

SEQ ID NO: 5617 - protein, 7 aa, Artificial Sequence
  Description of Artificial Sequence: Synthetic peptide
  XENP020017 vlCDR2
GAFSRAT

SEQ ID NO: 5618 - protein, 9 aa, Artificial Sequence
  Description of Artificial Sequence: Synthetic peptide
  XENP020017 vlCDR3
QQYGSSPWT

SEQ ID NO: 5619 - protein, 221 aa, Artificial Sequence; identical to SEQ ID NO: 5439
  Description of Artificial Sequence: Synthetic polypeptide
  XENP020018 [CTLA-4]_H3_L0.67_Fab Heavy Chain

SEQ ID NO: 5620 - protein, 118 aa, Artificial Sequence; identical to SEQ ID NO: 139
  Description of Artificial Sequence: Synthetic polypeptide
  VH of XENP020018

SEQ ID NO: 5621 - protein, 5 aa, Artificial Sequence
  Description of Artificial Sequence: Synthetic peptide
  XENP020018 vhCDR1
SYTMH

SEQ ID NO: 5622 - protein, 17 aa, Artificial Sequence
  Description of Artificial Sequence: Synthetic peptide
  XENP020018 vhCDR2
FISYDGNNKYYADSVKG

SEQ ID NO: 5623 - protein, 9 aa, Artificial Sequence
  Description of Artificial Sequence: Synthetic peptide
  XENP020018 vhCDR3
TGWLGPFDY

SEQ ID NO: 5624 - protein, 215 aa, Artificial Sequence; identical to SEQ ID NO: 4954
  Description of Artificial Sequence: Synthetic polypeptide
  XENP020018 [CTLA-4]_H3_L0.67_Fab Light Chain

SEQ ID NO: 5625 - protein, 108 aa, Artificial Sequence; identical to SEQ ID NO: 2012
  Description of Artificial Sequence: Synthetic polypeptide
  VL of XENP020018

SEQ ID NO: 5626 - protein, 12 aa, Artificial Sequence
  Description of Artificial Sequence: Synthetic peptide
  XENP020018 vlCDR1
RASQSVGSSYLA

SEQ ID NO: 5627 - protein, 7 aa, Artificial Sequence
  Description of Artificial Sequence: Synthetic peptide
  XENP020018 vlCDR2
DAFSRAT

SEQ ID NO: 5628 - protein, 9 aa, Artificial Sequence
  Description of Artificial Sequence: Synthetic peptide
  XENP020018 vlCDR3
QQYGSSPWT

SEQ ID NO: 5629 - protein, 221 aa, Artificial Sequence; identical to SEQ ID NO: 5439
  Description of Artificial Sequence: Synthetic polypeptide
  XENP020019 [CTLA-4]_H3_L0.69_Fab Heavy Chain

SEQ ID NO: 5630 - protein, 118 aa, Artificial Sequence; identical to SEQ ID NO: 139
  Description of Artificial Sequence: Synthetic polypeptide
  VH of XENP020019

SEQ ID NO: 5631 - protein, 5 aa, Artificial Sequence
  Description of Artificial Sequence: Synthetic peptide
  XENP020019 vhCDR1
SYTMH

SEQ ID NO: 5632 - protein, 17 aa, Artificial Sequence
  Description of Artificial Sequence: Synthetic peptide
  XENP020019 vhCDR2
FISYDGNNKYYADSVKG

SEQ ID NO: 5633 - protein, 9 aa, Artificial Sequence
  Description of Artificial Sequence: Synthetic peptide
  XENP020019 vhCDR3
TGWLGPFDY

SEQ ID NO: 5634 - protein, 215 aa, Artificial Sequence; identical to SEQ ID NO: 4974
  Description of Artificial Sequence: Synthetic polypeptide
  XENP020019 [CTLA-4]_H3_L0.69_Fab Light Chain

SEQ ID NO: 5635 - protein, 108 aa, Artificial Sequence; identical to SEQ ID NO: 2030
  Description of Artificial Sequence: Synthetic polypeptide
  VL of XENP020019

SEQ ID NO: 5636 - protein, 12 aa, Artificial Sequence
  Description of Artificial Sequence: Synthetic peptide
  XENP020019 vlCDR1
RASQSVGSSYLA

SEQ ID NO: 5637 - protein, 7 aa, Artificial Sequence
  Description of Artificial Sequence: Synthetic peptide
  XENP020019 vlCDR2
GVFSRAT

SEQ ID NO: 5638 - protein, 9 aa, Artificial Sequence
  Description of Artificial Sequence: Synthetic peptide
  XENP020019 vlCDR3
QQYGSSPWT

SEQ ID NO: 5639 - protein, 221 aa, Artificial Sequence; identical to SEQ ID NO: 5439
  Description of Artificial Sequence: Synthetic polypeptide
  XENP020020 [CTLA-4]_H3_L0.74_Fab Heavy Chain

SEQ ID NO: 5640 - protein, 118 aa, Artificial Sequence; identical to SEQ ID NO: 139
  Description of Artificial Sequence: Synthetic polypeptide
  VH of XENP020020

SEQ ID NO: 5641 - protein, 5 aa, Artificial Sequence
  Description of Artificial Sequence: Synthetic peptide
  XENP020020 vhCDR1
SYTMH

SEQ ID NO: 5642 - protein, 17 aa, Artificial Sequence
  Description of Artificial Sequence: Synthetic peptide
  XENP020020 vhCDR2
FISYDGNNKYYADSVKG

SEQ ID NO: 5643 - protein, 9 aa, Artificial Sequence
  Description of Artificial Sequence: Synthetic peptide
  XENP020020 vhCDR3
TGWLGPFDY

SEQ ID NO: 5644 - protein, 215 aa, Artificial Sequence; identical to SEQ ID NO: 5024
  Description of Artificial Sequence: Synthetic polypeptide
  XENP020020 [CTLA-4]_H3_L0.74_Fab Light Chain

SEQ ID NO: 5645 - protein, 108 aa, Artificial Sequence; identical to SEQ ID NO: 2075
  Description of Artificial Sequence: Synthetic polypeptide
  VL of XENP020020

SEQ ID NO: 5646 - protein, 12 aa, Artificial Sequence
  Description of Artificial Sequence: Synthetic peptide
  XENP020020 vlCDR1
RASQSVGSSYLA

SEQ ID NO: 5647 - protein, 7 aa, Artificial Sequence
  Description of Artificial Sequence: Synthetic peptide
  XENP020020 vlCDR2
GAYSRAT

SEQ ID NO: 5648 - protein, 9 aa, Artificial Sequence
  Description of Artificial Sequence: Synthetic peptide
  XENP020020 vlCDR3
QQYGSSPWT

SEQ ID NO: 5649 - protein, 221 aa, Artificial Sequence; identical to SEQ ID NO: 5439
  Description of Artificial Sequence: Synthetic polypeptide
  XENP020021 [CTLA-4]_H3_L0.75_Fab Heavy Chain

SEQ ID NO: 5650 - protein, 118 aa, Artificial Sequence; identical to SEQ ID NO: 139
  Description of Artificial Sequence: Synthetic polypeptide
  VH of XENP020021

SEQ ID NO: 5651 - protein, 5 aa, Artificial Sequence
  Description of Artificial Sequence: Synthetic peptide
  XENP020021 vhCDR1
SYTMH

SEQ ID NO: 5652 - protein, 17 aa, Artificial Sequence
  Description of Artificial Sequence: Synthetic peptide
  XENP020021 vhCDR2
FISYDGNNKYYADSVKG

SEQ ID NO: 5653 - protein, 9 aa, Artificial Sequence
  Description of Artificial Sequence: Synthetic peptide
  XENP020021 vhCDR3
TGWLGPFDY

SEQ ID NO: 5654 - protein, 215 aa, Artificial Sequence; identical to SEQ ID NO: 5034
  Description of Artificial Sequence: Synthetic polypeptide
  XENP020021 [CTLA-4]_H3_L0.75_Fab Light Chain

SEQ ID NO: 5655 - protein, 108 aa, Artificial Sequence; identical to SEQ ID NO: 2084
  Description of Artificial Sequence: Synthetic polypeptide
  VL of XENP020021

SEQ ID NO: 5656 - protein, 12 aa, Artificial Sequence
  Description of Artificial Sequence: Synthetic peptide
  XENP020021 vlCDR1
RASQSVGSSYLA

SEQ ID NO: 5657 - protein, 7 aa, Artificial Sequence
  Description of Artificial Sequence: Synthetic peptide
  XENP020021 vlCDR2
GAFARAT

SEQ ID NO: 5658 - protein, 9 aa, Artificial Sequence
  Description of Artificial Sequence: Synthetic peptide
  XENP020021 vlCDR3
QQYGSSPWT

SEQ ID NO: 5659 - protein, 221 aa, Artificial Sequence; identical to SEQ ID NO: 5439
  Description of Artificial Sequence: Synthetic polypeptide
  XENP020022 [CTLA-4]_H3_L0.103_Fab Heavy Chain

SEQ ID NO: 5660 - protein, 118 aa, Artificial Sequence; identical to SEQ ID NO: 139
  Description of Artificial Sequence: Synthetic polypeptide
  VH of XENP020022

SEQ ID NO: 5661 - protein, 5 aa, Artificial Sequence
  Description of Artificial Sequence: Synthetic peptide
  XENP020022 vhCDR1
SYTMH

SEQ ID NO: 5662 - protein, 17 aa, Artificial Sequence
  Description of Artificial Sequence: Synthetic peptide
  XENP020022 vhCDR2
FISYDGNNKYYADSVKG

SEQ ID NO: 5663 - protein, 9 aa, Artificial Sequence
  Description of Artificial Sequence: Synthetic peptide
  XENP020022 vhCDR3
TGWLGPFDY

SEQ ID NO: 5664 - protein, 215 aa, Artificial Sequence; identical to SEQ ID NO: 5314
  Description of Artificial Sequence: Synthetic polypeptide
  XENP020022 [CTLA-4]_H3_L0.103_Fab Light Chain

SEQ ID NO: 5665 - protein, 108 aa, Artificial Sequence; identical to SEQ ID NO: 2336
  Description of Artificial Sequence: Synthetic polypeptide
  VL of XENP020022

SEQ ID NO: 5666 - protein, 12 aa, Artificial Sequence
  Description of Artificial Sequence: Synthetic peptide
  XENP020022 vlCDR1
RASQSVGSSYLA

SEQ ID NO: 5667 - protein, 7 aa, Artificial Sequence
  Description of Artificial Sequence: Synthetic peptide
  XENP020022 vlCDR2
GAFSRAT

SEQ ID NO: 5668 - protein, 9 aa, Artificial Sequence
  Description of Artificial Sequence: Synthetic peptide
  XENP020022 vlCDR3
QQYGKSPWT

SEQ ID NO: 5669 - protein, 221 aa, Artificial Sequence; identical to SEQ ID NO: 5439
  Description of Artificial Sequence: Synthetic polypeptide
  XENP020052 [CTLA-4]_H3_L0.44_Fab Heavy Chain

SEQ ID NO: 5670 - protein, 118 aa, Artificial Sequence; identical to SEQ ID NO: 139
  Description of Artificial Sequence: Synthetic polypeptide
  VH of XENP020052

SEQ ID NO: 5671 - protein, 5 aa, Artificial Sequence
  Description of Artificial Sequence: Synthetic peptide
  XENP020052 vhCDR1
SYTMH

SEQ ID NO: 5672 - protein, 17 aa, Artificial Sequence
  Description of Artificial Sequence: Synthetic peptide
  XENP020052 vhCDR2
FISYDGNNKYYADSVKG

SEQ ID NO: 5673 - protein, 9 aa, Artificial Sequence
  Description of Artificial Sequence: Synthetic peptide
  XENP020052 vhCDR3
TGWLGPFDY

SEQ ID NO: 5674 - protein, 215 aa, Artificial Sequence; identical to SEQ ID NO: 4724
  Description of Artificial Sequence: Synthetic polypeptide
  XENP020052 [CTLA-4]_H3_L0.44_Fab Light Chain

SEQ ID NO: 5675 - protein, 108 aa, Artificial Sequence; identical to SEQ ID NO: 1805
  Description of Artificial Sequence: Synthetic polypeptide
  VL of XENP020052

SEQ ID NO: 5676 - protein, 12 aa, Artificial Sequence
  Description of Artificial Sequence: Synthetic peptide
  XENP020052 vlCDR1
RASQSVGSSYLS

SEQ ID NO: 5677 - protein, 7 aa, Artificial Sequence
  Description of Artificial Sequence: Synthetic peptide
  XENP020052 vlCDR2
GAFSRAT

SEQ ID NO: 5678 - protein, 9 aa, Artificial Sequence
  Description of Artificial Sequence: Synthetic peptide
  XENP020052 vlCDR3
QQYGSSPWT

SEQ ID NO: 5679 - protein, 221 aa, Artificial Sequence
  Description of Artificial Sequence: Synthetic polypeptide
  XENP020068 [CTLA-4]_H3.1_L0.12_Fab Heavy Chain
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGLLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5680 - protein, 118 aa, Artificial Sequence; identical to SEQ ID NO: 2434
  Description of Artificial Sequence: Synthetic polypeptide
  VH of XENP020068

SEQ ID NO: 5681 - protein, 5 aa, Artificial Sequence
  Description of Artificial Sequence: Synthetic peptide
  XENP020068 vhCDR1
SYTMH

SEQ ID NO: 5682 - protein, 17 aa, Artificial Sequence
  Description of Artificial Sequence: Synthetic peptide
  XENP020068 vhCDR2
FISYDGNHKYYADSVKG

SEQ ID NO: 5683 - protein, 9 aa, Artificial Sequence
  Description of Artificial Sequence: Synthetic peptide
  XENP020068 vhCDR3
TGLLGPFDL

SEQ ID NO: 5684 - protein, 215 aa, Artificial Sequence; identical to SEQ ID NO: 4404
  Description of Artificial Sequence: Synthetic polypeptide
  XENP020068 [CTLA-4]_H3.1_L0.12_Fab Light Chain

SEQ ID NO: 5685 - protein, 108 aa, Artificial Sequence; identical to SEQ ID NO: 1517
  Description of Artificial Sequence: Synthetic polypeptide
  VL of XENP020068

SEQ ID NO: 5686 - protein, 12 aa, Artificial Sequence
  Description of Artificial Sequence: Synthetic peptide
  XENP020068 vlCDR1
RASQSVGSSYLA

SEQ ID NO: 5687 - protein, 7 aa, Artificial Sequence
  Description of Artificial Sequence: Synthetic peptide
  XENP020068 vlCDR2
GAFSRAT

SEQ ID NO: 5688 - protein, 9 aa, Artificial Sequence
  Description of Artificial Sequence: Synthetic peptide
  XENP020068 vlCDR3
QQYGSSPWT

SEQ ID NO: 5689 - protein, 221 aa, Artificial Sequence
  Description of Artificial Sequence: Synthetic polypeptide
  XENP020069 [CTLA-4]_H3.2_L0.12_Fab Heavy Chain
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTGLLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5690 - protein, 118 aa, Artificial Sequence; identical to SEQ ID NO: 2443
  Description of Artificial Sequence: Synthetic polypeptide
  VH of XENP020069

SEQ ID NO: 5691 - protein, 5 aa, Artificial Sequence
  Description of Artificial Sequence: Synthetic peptide
  XENP020069 vhCDR1
SYTMH

SEQ ID NO: 5692 - protein, 17 aa, Artificial Sequence
  Description of Artificial Sequence: Synthetic peptide
  XENP020069 vhCDR2
FISYDGNTKYYADSVKG

SEQ ID NO: 5693 - protein, 9 aa, Artificial Sequence
  Description of Artificial Sequence: Synthetic peptide
  XENP020069 vhCDR3
TGLLGPFDL

SEQ ID NO: 5694 - protein, 215 aa, Artificial Sequence; identical to SEQ ID NO: 4404
  Description of Artificial Sequence: Synthetic polypeptide
  XENP020069 [CTLA-4]_H3.2_L0.12_Fab Light Chain

SEQ ID NO: 5695 - protein, 108 aa, Artificial Sequence; identical to SEQ ID NO: 1517
  Description of Artificial Sequence: Synthetic polypeptide
  VL of XENP020069

SEQ ID NO: 5696 - protein, 12 aa, Artificial Sequence
  Description of Artificial Sequence: Synthetic peptide
  XENP020069 vlCDR1
RASQSVGSSYLA

SEQ ID NO: 5697 - protein, 7 aa, Artificial Sequence
  Description of Artificial Sequence: Synthetic peptide
  XENP020069 vlCDR2
GAFSRAT

SEQ ID NO: 5698 - protein, 9 aa, Artificial Sequence
  Description of Artificial Sequence: Synthetic peptide
  XENP020069 vlCDR3
QQYGSSPWT

SEQ ID NO: 5699 - protein, 221 aa, Artificial Sequence
  Description of Artificial Sequence: Synthetic polypeptide
  XENP020070 [CTLA-4]_H3.3_L0.12_Fab Heavy Chain
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARTGLLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5700 - protein, 118 aa, Artificial Sequence; identical to SEQ ID NO: 2452
  Description of Artificial Sequence: Synthetic polypeptide
  VH of XENP020070

SEQ ID NO: 5701 - protein, 5 aa, Artificial Sequence
  Description of Artificial Sequence: Synthetic peptide
  XENP020070 vhCDR1
SYTMH

SEQ ID NO: 5702 - protein, 17 aa, Artificial Sequence
  Description of Artificial Sequence: Synthetic peptide
  XENP020070 vhCDR2
FISYDGNQKYYADSVKG

SEQ ID NO: 5703 - protein, 9 aa, Artificial Sequence
  Description of Artificial Sequence: Synthetic peptide
  XENP020070 vhCDR3
TGLLGPFDL

SEQ ID NO: 5704 - protein, 215 aa, Artificial Sequence; identical to SEQ ID NO: 4404
  Description of Artificial Sequence: Synthetic polypeptide
  XENP020070 [CTLA-4]_H3.3_L0.12_Fab Light Chain

SEQ ID NO: 5705 - protein, 108 aa, Artificial Sequence; identical to SEQ ID NO: 1517
  Description of Artificial Sequence: Synthetic polypeptide
  VL of XENP020070

SEQ ID NO: 5706 - protein, 12 aa, Artificial Sequence
  Description of Artificial Sequence: Synthetic peptide
  XENP020070 vlCDR1
RASQSVGSSYLA

SEQ ID NO: 5707 - protein, 7 aa, Artificial Sequence
  Description of Artificial Sequence: Synthetic peptide
  XENP020070 vlCDR2
GAFSRAT

SEQ ID NO: 5708 - protein, 9 aa, Artificial Sequence
  Description of Artificial Sequence: Synthetic peptide
  XENP020070 vlCDR3
QQYGSSPWT

SEQ ID NO: 5709 - protein, 221 aa, Artificial Sequence
  Description of Artificial Sequence: Synthetic polypeptide
  XENP020071 [CTLA-4]_H3.4_L0.12_Fab Heavy Chain
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTGHLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5710 - protein, 118 aa, Artificial Sequence; identical to SEQ ID NO: 2461
  Description of Artificial Sequence: Synthetic polypeptide
  VH of XENP020071

SEQ ID NO: 5711 - protein, 5 aa, Artificial Sequence
  Description of Artificial Sequence: Synthetic peptide
  XENP020071 vhCDR1
SYTMH

SEQ ID NO: 5712 - protein, 17 aa, Artificial Sequence
  Description of Artificial Sequence: Synthetic peptide
  XENP020071 vhCDR2
FISYDGNHKYYADSVKG

SEQ ID NO: 5713 - protein, 9 aa, Artificial Sequence
  Description of Artificial Sequence: Synthetic peptide
  XENP020071 vhCDR3
TGHLGPFDL

SEQ ID NO: 5714 - protein, 215 aa, Artificial Sequence; identical to SEQ ID NO: 4404
  Description of Artificial Sequence: Synthetic polypeptide
  XENP020071 [CTLA-4]_H3.4_L0.12_Fab Light Chain

SEQ ID NO: 5715 - protein, 108 aa, Artificial Sequence; identical to SEQ ID NO: 1517
  Description of Artificial Sequence: Synthetic polypeptide
  VL of XENP020071

SEQ ID NO: 5716 - protein, 12 aa, Artificial Sequence
  Description of Artificial Sequence: Synthetic peptide
  XENP020071 vlCDR1
RASQSVGSSYLA

SEQ ID NO: 5717 - protein, 7 aa, Artificial Sequence
  Description of Artificial Sequence: Synthetic peptide
  XENP020071 vlCDR2
GAFSRAT

SEQ ID NO: 5718 - protein, 9 aa, Artificial Sequence
  Description of Artificial Sequence: Synthetic peptide
  XENP020071 vlCDR3
QQYGSSPWT

SEQ ID NO: 5719 - protein, 221 aa, Artificial Sequence
  Description of Artificial Sequence: Synthetic polypeptide
  XENP020072 [CTLA-4]_H3.5_L0.12_Fab Heavy Chain
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTGHLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5720 - protein, 118 aa, Artificial Sequence; identical to SEQ ID NO: 2470
  Description of Artificial Sequence: Synthetic polypeptide
  VH of XENP020072

SEQ ID NO: 5721 - protein, 5 aa, Artificial Sequence
  Description of Artificial Sequence: Synthetic peptide
  XENP020072 vhCDR1
SYTMH

SEQ ID NO: 5722 - protein, 17 aa, Artificial Sequence
  Description of Artificial Sequence: Synthetic peptide
  XENP020072 vhCDR2
FISYDGNTKYYADSVKG

SEQ ID NO: 5723 - protein, 9 aa, Artificial Sequence
  Description of Artificial Sequence: Synthetic peptide
  XENP020072 vhCDR3
TGHLGPFDL

SEQ ID NO: 5724 - protein, 215 aa, Artificial Sequence; identical to SEQ ID NO: 4404
  Description of Artificial Sequence: Synthetic polypeptide
  XENP020072 [CTLA-4]_H3.5_L0.12_Fab Light Chain

SEQ ID NO: 5725 - protein, 108 aa, Artificial Sequence; identical to SEQ ID NO: 1517
  Description of Artificial Sequence: Synthetic polypeptide
  VL of XENP020072

SEQ ID NO: 5726 - protein, 12 aa, Artificial Sequence
  Description of Artificial Sequence: Synthetic peptide
  XENP020072 vlCDR1
RASQSVGSSYLA

SEQ ID NO: 5727 - protein, 7 aa, Artificial Sequence
  Description of Artificial Sequence: Synthetic peptide
  XENP020072 vlCDR2
GAFSRAT

SEQ ID NO: 5728 - protein, 9 aa, Artificial Sequence
  Description of Artificial Sequence: Synthetic peptide
  XENP020072 vlCDR3
QQYGSSPWT

SEQ ID NO: 5729 - protein, 221 aa, Artificial Sequence
  Description of Artificial Sequence: Synthetic polypeptide
  XENP020073 [CTLA-4]_H3.6_L0.12_Fab Heavy Chain
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARTGHLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5730 - protein, 118 aa, Artificial Sequence; identical to SEQ ID NO: 2479
  Description of Artificial Sequence: Synthetic polypeptide
  VH of XENP020073

SEQ ID NO: 5731 - protein, 5 aa, Artificial Sequence
  Description of Artificial Sequence: Synthetic peptide
  XENP020073 vhCDR1
SYTMH

SEQ ID NO: 5732 - protein, 17 aa, Artificial Sequence
  Description of Artificial Sequence: Synthetic peptide
  XENP020073 vhCDR2
FISYDGNQKYYADSVKG

SEQ ID NO: 5733 - protein, 9 aa, Artificial Sequence
  Description of Artificial Sequence: Synthetic peptide
  XENP020073 vhCDR3
TGHLGPFDL

SEQ ID NO: 5734 - protein, 215 aa, Artificial Sequence; identical to SEQ ID NO: 4404
  Description of Artificial Sequence: Synthetic polypeptide
  XENP020073 [CTLA-4]_H3.6_L0.12_Fab Light Chain

SEQ ID NO: 5735 - protein, 108 aa, Artificial Sequence; identical to SEQ ID NO: 1517
  Description of Artificial Sequence: Synthetic polypeptide
  VL of XENP020073

SEQ ID NO: 5736 - protein, 12 aa, Artificial Sequence
  Description of Artificial Sequence: Synthetic peptide
  XENP020073 vlCDR1
RASQSVGSSYLA

SEQ ID NO: 5737 - protein, 7 aa, Artificial Sequence
  Description of Artificial Sequence: Synthetic peptide
  XENP020073 vlCDR2
GAFSRAT

SEQ ID NO: 5738 - protein, 9 aa, Artificial Sequence
  Description of Artificial Sequence: Synthetic peptide
  XENP020073 vlCDR3
QQYGSSPWT

SEQ ID NO: 5739 - protein, 221 aa, Artificial Sequence
  Description of Artificial Sequence: Synthetic polypeptide
  XENP020074 [CTLA-4]_H3.7_L0.12_Fab Heavy Chain
EVQLVESGGGLVKPGGSLRLSCAASGFTFSSYTMHWVRQAPGKGLEWVCFISYDGNNKYYADSVKGRFTCSRDNAKNSLYLQMNSLRAEDTAVYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5740 - protein, 118 aa, Artificial Sequence; identical to SEQ ID NO: 2488
  Description of Artificial Sequence: Synthetic polypeptide
  VH of XENP020074

SEQ ID NO: 5741 - protein, 5 aa, Artificial Sequence
  Description of Artificial Sequence: Synthetic peptide
  XENP020074 vhCDR1
SYTMH

SEQ ID NO: 5742 - protein, 17 aa, Artificial Sequence
  Description of Artificial Sequence: Synthetic peptide
  XENP020074 vhCDR2
FISYDGNNKYYADSVKG

SEQ ID NO: 5743 - protein, 9 aa, Artificial Sequence
  Description of Artificial Sequence: Synthetic peptide
  XENP020074 vhCDR3
TGWLGPFDY

SEQ ID NO: 5744 - protein, 215 aa, Artificial Sequence; identical to SEQ ID NO: 4404
  Description of Artificial Sequence: Synthetic polypeptide
  XENP020074 [CTLA-4]_H3.7_L0.12_Fab Light Chain

SEQ ID NO: 5745 - protein, 108 aa, Artificial Sequence; identical to SEQ ID NO: 1517
  Description of Artificial Sequence: Synthetic polypeptide
  VL of XENP020074

SEQ ID NO: 5746 - protein, 12 aa, Artificial Sequence
  Description of Artificial Sequence: Synthetic peptide
  XENP020074 vlCDR1
RASQSVGSSYLA

SEQ ID NO: 5747 - protein, 7 aa, Artificial Sequence
  Description of Artificial Sequence: Synthetic peptide
  XENP020074 vlCDR2
GAFSRAT

SEQ ID NO: 5748 - protein, 9 aa, Artificial Sequence
  Description of Artificial Sequence: Synthetic peptide
  XENP020074 vlCDR3
QQYGSSPWT

SEQ ID NO: 5749 - protein, 221 aa, Artificial Sequence
  Description of Artificial Sequence: Synthetic polypeptide
  XENP020323 [CTLA-4]_H3.9_L0.12_Fab Heavy Chain
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARTGHLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5750 - protein, 118 aa, Artificial Sequence; identical to SEQ ID NO: 2506
  Description of Artificial Sequence: Synthetic polypeptide
  VH of XENP020323

SEQ ID NO: 5751 - protein, 5 aa, Artificial Sequence
  Description of Artificial Sequence: Synthetic peptide
  XENP020323 vhCDR1
SYTMH

SEQ ID NO: 5752 - protein, 17 aa, Artificial Sequence
  Description of Artificial Sequence: Synthetic peptide
  XENP020323 vhCDR2
FISYDGNYKYYADSVKG

SEQ ID NO: 5753 - protein, 9 aa, Artificial Sequence
  Description of Artificial Sequence: Synthetic peptide
  XENP020323 vhCDR3
TGHLGPFDL

SEQ ID NO: 5754 - protein, 215 aa, Artificial Sequence; identical to SEQ ID NO: 4404
  Description of Artificial Sequence: Synthetic polypeptide
  XENP020323 [CTLA-4]_H3.9_L0.12_Fab Light Chain

SEQ ID NO: 5755 - protein, 108 aa, Artificial Sequence; identical to SEQ ID NO: 1517
  Description of Artificial Sequence: Synthetic polypeptide
  VL of XENP020323

SEQ ID NO: 5756 - protein, 12 aa, Artificial Sequence
  Description of Artificial Sequence: Synthetic peptide
  XENP020323 vlCDR1
RASQSVGSSYLA

SEQ ID NO: 5757 - protein, 7 aa, Artificial Sequence
  Description of Artificial Sequence: Synthetic peptide
  XENP020323 vlCDR2
GAFSRAT

SEQ ID NO: 5758 - protein, 9 aa, Artificial Sequence
  Description of Artificial Sequence: Synthetic peptide
  XENP020323 vlCDR3
QQYGSSPWT

SEQ ID NO: 5759 - protein, 221 aa, Artificial Sequence
  Description of Artificial Sequence: Synthetic polypeptide
  XENP020324 [CTLA-4]_H3.10_L0.12_Fab Heavy Chain
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARTGLLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5760 - protein, 118 aa, Artificial Sequence; identical to SEQ ID NO: 2515
  Description of Artificial Sequence: Synthetic polypeptide
  VH of XENP020324

SEQ ID NO: 5761 - protein, 5 aa, Artificial Sequence
  Description of Artificial Sequence: Synthetic peptide
  XENP020324 vhCDR1
SYTMH

SEQ ID NO: 5762 - protein, 17 aa, Artificial Sequence
  Description of Artificial Sequence: Synthetic peptide
  XENP020324 vhCDR2
FISYDGNYKYYADSVKG

SEQ ID NO: 5763 - protein, 9 aa, Artificial Sequence
  Description of Artificial Sequence: Synthetic peptide
  XENP020324 vhCDR3
TGLLGPFDL

SEQ ID NO: 5764 - protein, 215 aa, Artificial Sequence; identical to SEQ ID NO: 4404
  Description of Artificial Sequence: Synthetic polypeptide
  XENP020324 [CTLA-4]_H3.10_L0.12_Fab Light Chain

SEQ ID NO: 5765 - protein, 108 aa, Artificial Sequence; identical to SEQ ID NO: 1517
  Description of Artificial Sequence: Synthetic polypeptide
  VL of XENP020324

SEQ ID NO: 5766 - protein, 12 aa, Artificial Sequence
  Description of Artificial Sequence: Synthetic peptide
  XENP020324 vlCDR1
RASQSVGSSYLA

SEQ ID NO: 5767 - protein, 7 aa, Artificial Sequence
  Description of Artificial Sequence: Synthetic peptide
  XENP020324 vlCDR2
GAFSRAT

SEQ ID NO: 5768 - protein, 9 aa, Artificial Sequence
  Description of Artificial Sequence: Synthetic peptide
  XENP020324 vlCDR3
QQYGSSPWT

SEQ ID NO: 5769 - protein, 221 aa, Artificial Sequence
  Description of Artificial Sequence: Synthetic polypeptide
  XENP020325 [CTLA-4]_H3.11_L0.12_Fab Heavy Chain
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARGGHLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5770 - protein, 118 aa, Artificial Sequence; identical to SEQ ID NO: 2524
  Description of Artificial Sequence: Synthetic polypeptide
  VH of XENP020325

SEQ ID NO: 5771 - protein, 5 aa, Artificial Sequence
  Description of Artificial Sequence: Synthetic peptide
  XENP020325 vhCDR1
SYTMH

SEQ ID NO: 5772 - protein, 17 aa, Artificial Sequence
  Description of Artificial Sequence: Synthetic peptide
  XENP020325 vhCDR2
FISYDGNHKYYADSVKG

SEQ ID NO: 5773 - protein, 9 aa, Artificial Sequence
  Description of Artificial Sequence: Synthetic peptide
  XENP020325 vhCDR3
GGHLGPFDL

SEQ ID NO: 5774 - protein, 215 aa, Artificial Sequence; identical to SEQ ID NO: 4404
  Description of Artificial Sequence: Synthetic polypeptide
  XENP020325 [CTLA-4]_H3.11_L0.12_Fab Light Chain

SEQ ID NO: 5775 - protein, 108 aa, Artificial Sequence; identical to SEQ ID NO: 1517
  Description of Artificial Sequence: Synthetic polypeptide
  VL of XENP020325

SEQ ID NO: 5776 - protein, 12 aa, Artificial Sequence
  Description of Artificial Sequence: Synthetic peptide
  XENP020325 vlCDR1
RASQSVGSSYLA

SEQ ID NO: 5777 - protein, 7 aa, Artificial Sequence
  Description of Artificial Sequence: Synthetic peptide
  XENP020325 vlCDR2
GAFSRAT

SEQ ID NO: 5778 - protein, 9 aa, Artificial Sequence
  Description of Artificial Sequence: Synthetic peptide
  XENP020325 vlCDR3
QQYGSSPWT

SEQ ID NO: 5779 - protein, 221 aa, Artificial Sequence
  Description of Artificial Sequence: Synthetic polypeptide
  XENP020326 [CTLA-4]_H3.12_L0.12_Fab Heavy Chain
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTSHLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5780 - protein, 118 aa, Artificial Sequence; identical to SEQ ID NO: 2533
  Description of Artificial Sequence: Synthetic polypeptide
  VH of XENP020326

SEQ ID NO: 5781 - protein, 5 aa, Artificial Sequence
  Description of Artificial Sequence: Synthetic peptide
  XENP020326 vhCDR1
SYTMH

SEQ ID NO: 5782 - protein, 17 aa, Artificial Sequence
  Description of Artificial Sequence: Synthetic peptide
  XENP020326 vhCDR2
FISYDGNHKYYADSVKG

SEQ ID NO: 5783 - protein, 9 aa, Artificial Sequence
  Description of Artificial Sequence: Synthetic peptide
  XENP020326 vhCDR3
TSHLGPFDL

SEQ ID NO: 5784 - protein, 215 aa, Artificial Sequence; identical to SEQ ID NO: 4404
  Description of Artificial Sequence: Synthetic polypeptide
  XENP020326 [CTLA-4]_H3.12_L0.12_Fab Light Chain

SEQ ID NO: 5785 - protein, 108 aa, Artificial Sequence; identical to SEQ ID NO: 1517
  Description of Artificial Sequence: Synthetic polypeptide
  VL of XENP020326

SEQ ID NO: 5786 - protein, 12 aa, Artificial Sequence
  Description of Artificial Sequence: Synthetic peptide
  XENP020326 vlCDR1
RASQSVGSSYLA

SEQ ID NO: 5787 - protein, 7 aa, Artificial Sequence
  Description of Artificial Sequence: Synthetic peptide
  XENP020326 vlCDR2
GAFSRAT

SEQ ID NO: 5788 - protein, 9 aa, Artificial Sequence
  Description of Artificial Sequence: Synthetic peptide
  XENP020326 vlCDR3
QQYGSSPWT

SEQ ID NO: 5789 - protein, 221 aa, Artificial Sequence
  Description of Artificial Sequence: Synthetic polypeptide
  XENP020327 [CTLA-4]_H3.13_L0.12_Fab Heavy Chain
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARGGLLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5790 - protein, 118 aa, Artificial Sequence; identical to SEQ ID NO: 2542
  Description of Artificial Sequence: Synthetic polypeptide
  VH of XENP020327

SEQ ID NO: 5791 - protein, 5 aa, Artificial Sequence
  Description of Artificial Sequence: Synthetic peptide
  XENP020327 vhCDR1
SYTMH

SEQ ID NO: 5792 - protein, 17 aa, Artificial Sequence
  Description of Artificial Sequence: Synthetic peptide
  XENP020327 vhCDR2
FISYDGNHKYYADSVKG

SEQ ID NO: 5793 - protein, 9 aa, Artificial Sequence
  Description of Artificial Sequence: Synthetic peptide
  XENP020327 vhCDR3
GGLLGPFDL

SEQ ID NO: 5794 - protein, 215 aa, Artificial Sequence; identical to SEQ ID NO: 4404
  Description of Artificial Sequence: Synthetic polypeptide
  XENP020327 [CTLA-4]_H3.13_L0.12_Fab Light Chain

SEQ ID NO: 5795 - protein, 108 aa, Artificial Sequence; identical to SEQ ID NO: 1517
  Description of Artificial Sequence: Synthetic polypeptide
  VL of XENP020327

SEQ ID NO: 5796 - protein, 12 aa, Artificial Sequence
  Description of Artificial Sequence: Synthetic peptide
  XENP020327 vlCDR1
RASQSVGSSYLA

SEQ ID NO: 5797 - protein, 7 aa, Artificial Sequence
  Description of Artificial Sequence: Synthetic peptide
  XENP020327 vlCDR2
GAFSRAT

SEQ ID NO: 5798 - protein, 9 aa, Artificial Sequence
  Description of Artificial Sequence: Synthetic peptide
  XENP020327 vlCDR3
QQYGSSPWT

SEQ ID NO: 5799 - protein, 221 aa, Artificial Sequence
  Description of Artificial Sequence: Synthetic polypeptide
  XENP020328 [CTLA-4]_H3.14_L0.12_Fab Heavy Chain
EVQLVESGGGLVKPGGSLRLSCAASGFTFSSYTMHWVRQAPGKGLEWVSFISYDGNHKYYADSVKGRFTISRDNAKNSLYLQMNSLRAEDTAVYYCARTSLLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5800 - protein, 118 aa, Artificial Sequence; identical to SEQ ID NO: 2551
  Description of Artificial Sequence: Synthetic polypeptide
  VH of XENP020328

SEQ ID NO: 5801 - protein, 5 aa, Artificial Sequence
  Description of Artificial Sequence: Synthetic peptide
  XENP020328 vhCDR1
SYTMH

SEQ ID NO: 5802 - protein, 17 aa, Artificial Sequence
  Description of Artificial Sequence: Synthetic peptide
  XENP020328 vhCDR2
FISYDGNHKYYADSVKG

SEQ ID NO: 5803 - protein, 9 aa, Artificial Sequence
  Description of Artificial Sequence: Synthetic peptide
  XENP020328 vhCDR3
TSLLGPFDL

SEQ ID NO: 5804 - protein, 215 aa, Artificial Sequence; identical to SEQ ID NO: 4404
  Description of Artificial Sequence: Synthetic polypeptide
  XENP020328 [CTLA-4]_H3.14_L0.12_Fab Light Chain

SEQ ID NO: 5805 - protein, 108 aa, Artificial Sequence; identical to SEQ ID NO: 1517
  Description of Artificial Sequence: Synthetic polypeptide
  VL of XENP020328

SEQ ID NO: 5806 - protein, 12 aa, Artificial Sequence
  Description of Artificial Sequence: Synthetic peptide
  XENP020328 vlCDR1
RASQSVGSSYLA

SEQ ID NO: 5807 - protein, 7 aa, Artificial Sequence
  Description of Artificial Sequence: Synthetic peptide
  XENP020328 vlCDR2
GAFSRAT

SEQ ID NO: 5808 - protein, 9 aa, Artificial Sequence
  Description of Artificial Sequence: Synthetic peptide
  XENP020328 vlCDR3
QQYGSSPWT

SEQ ID NO: 5809 - protein, 221 aa, Artificial Sequence
  Description of Artificial Sequence: Synthetic polypeptide
  XENP020329 [CTLA-4]_H3.15_L0.12_Fab Heavy Chain
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARGGHLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5810 - protein, 118 aa, Artificial Sequence; identical to SEQ ID NO: 2560
  Description of Artificial Sequence: Synthetic polypeptide
  VH of XENP020329

SEQ ID NO: 5811 - protein, 5 aa, Artificial Sequence
  Description of Artificial Sequence: Synthetic peptide
  XENP020329 vhCDR1
SYTMH

SEQ ID NO: 5812 - protein, 17 aa, Artificial Sequence
  Description of Artificial Sequence: Synthetic peptide
  XENP020329 vhCDR2
FISYDGNQKYYADSVKG

SEQ ID NO: 5813 - protein, 9 aa, Artificial Sequence
  Description of Artificial Sequence: Synthetic peptide
  XENP020329 vhCDR3
GGHLGPFDL

SEQ ID NO: 5814 - protein, 215 aa, Artificial Sequence; identical to SEQ ID NO: 4404
  Description of Artificial Sequence: Synthetic polypeptide
  XENP020329 [CTLA-4]_H3.15_L0.12_Fab Light Chain

SEQ ID NO: 5815 - protein, 108 aa, Artificial Sequence; identical to SEQ ID NO: 1517
  Description of Artificial Sequence: Synthetic polypeptide
  VL of XENP020329

SEQ ID NO: 5816 - protein, 12 aa, Artificial Sequence
  Description of Artificial Sequence: Synthetic peptide
  XENP020329 vlCDR1
RASQSVGSSYLA

SEQ ID NO: 5817 - protein, 7 aa, Artificial Sequence
  Description of Artificial Sequence: Synthetic peptide
  XENP020329 vlCDR2
GAFSRAT

SEQ ID NO: 5818 - protein, 9 aa, Artificial Sequence
  Description of Artificial Sequence: Synthetic peptide
  XENP020329 vlCDR3
QQYGSSPWT

SEQ ID NO: 5819 - protein, 221 aa, Artificial Sequence
  Description of Artificial Sequence: Synthetic polypeptide
  XENP020330 [CTLA-4]_H3.16_L0.12_Fab Heavy Chain
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARTSHLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5820 - protein, 118 aa, Artificial Sequence; identical to SEQ ID NO: 2569
  Description of Artificial Sequence: Synthetic polypeptide
  VH of XENP020330

SEQ ID NO: 5821 - protein, 5 aa, Artificial Sequence
  Description of Artificial Sequence: Synthetic peptide
  XENP020330 vhCDR1
SYTMH

SEQ ID NO: 5822 - protein, 17 aa, Artificial Sequence
  Description of Artificial Sequence: Synthetic peptide
  XENP020330 vhCDR2
FISYDGNQKYYADSVKG

SEQ ID NO: 5823 - protein, 9 aa, Artificial Sequence
  Description of Artificial Sequence: Synthetic peptide
  XENP020330 vhCDR3
TSHLGPFDL

SEQ ID NO: 5824 - protein, 215 aa, Artificial Sequence; identical to SEQ ID NO: 4404
  Description of Artificial Sequence: Synthetic polypeptide
  XENP020330 [CTLA-4]_H3.16_L0.12_Fab Light Chain

SEQ ID NO: 5825 - protein, 108 aa, Artificial Sequence; identical to SEQ ID NO: 1517
  Description of Artificial Sequence: Synthetic polypeptide
  VL of XENP020330

SEQ ID NO: 5826 - protein, 12 aa, Artificial Sequence
  Description of Artificial Sequence: Synthetic peptide
  XENP020330 vlCDR1
RASQSVGSSYLA

SEQ ID NO: 5827 - protein, 7 aa, Artificial Sequence
  Description of Artificial Sequence: Synthetic peptide
  XENP020330 vlCDR2
GAFSRAT

SEQ ID NO: 5828 - protein, 9 aa, Artificial Sequence
  Description of Artificial Sequence: Synthetic peptide
  XENP020330 vlCDR3
QQYGSSPWT

SEQ ID NO: 5829 - protein, 221 aa, Artificial Sequence
  Description of Artificial Sequence: Synthetic polypeptide
  XENP020331 [CTLA-4]_H3.17_L0.12_Fab Heavy Chain
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARGGLLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5830 - protein, 118 aa, Artificial Sequence; identical to SEQ ID NO: 2578
  Description of Artificial Sequence: Synthetic polypeptide
  VH of XENP020331

SEQ ID NO: 5831 - protein, 5 aa, Artificial Sequence
  Description of Artificial Sequence: Synthetic peptide
  XENP020331 vhCDR1
SYTMH

SEQ ID NO: 5832 - protein, 17 aa, Artificial Sequence
  Description of Artificial Sequence: Synthetic peptide
  XENP020331 vhCDR2
FISYDGNQKYYADSVKG

SEQ ID NO: 5833 - protein, 9 aa, Artificial Sequence
  Description of Artificial Sequence: Synthetic peptide
  XENP020331 vhCDR3
GGLLGPFDL

SEQ ID NO: 5834 - protein, 215 aa, Artificial Sequence; identical to SEQ ID NO: 4404
  Description of Artificial Sequence: Synthetic polypeptide
  XENP020331 [CTLA-4]_H3.17_L0.12_Fab Light Chain

SEQ ID NO: 5835 - protein, 108 aa, Artificial Sequence; identical to SEQ ID NO: 1517
  Description of Artificial Sequence: Synthetic polypeptide
  VL of XENP020331

SEQ ID NO: 5836 - protein, 12 aa, Artificial Sequence
  Description of Artificial Sequence: Synthetic peptide
  XENP020331 vlCDR1
RASQSVGSSYLA

SEQ ID NO: 5837 - protein, 7 aa, Artificial Sequence
  Description of Artificial Sequence: Synthetic peptide
  XENP020331 vlCDR2
GAFSRAT

SEQ ID NO: 5838 - protein, 9 aa, Artificial Sequence
  Description of Artificial Sequence: Synthetic peptide
  XENP020331 vlCDR3
QQYGSSPWT

SEQ ID NO: 5839 - protein, 221 aa, Artificial Sequence
  Description of Artificial Sequence: Synthetic polypeptide
  XENP020332 [CTLA-4]_H3.18_L0.12_Fab Heavy Chain
EVQLVESGGGLVKPGGSLRLSCAASGFTFSSYTMHWVRQAPGKGLEWVSFISYDGNQKYYADSVKGRFTISRDNAKNSLYLQMNSLRAEDTAVYYCARTSLLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5840 - protein, 118 aa, Artificial Sequence; identical to SEQ ID NO: 2587
  Description of Artificial Sequence: Synthetic polypeptide
  VH of XENP020332

SEQ ID NO: 5841 - protein, 5 aa, Artificial Sequence
  Description of Artificial Sequence: Synthetic peptide
  XENP020332 vhCDR1
SYTMH

SEQ ID NO: 5842 - protein, 17 aa, Artificial Sequence
  Description of Artificial Sequence: Synthetic peptide
  XENP020332 vhCDR2
FISYDGNQKYYADSVKG

SEQ ID NO: 5843 - protein, 9 aa, Artificial Sequence
  Description of Artificial Sequence: Synthetic peptide
  XENP020332 vhCDR3
TSLLGPFDL

SEQ ID NO: 5844 - protein, 215 aa, Artificial Sequence; identical to SEQ ID NO: 4404
  Description of Artificial Sequence: Synthetic polypeptide
  XENP020332 [CTLA-4]_H3.18_L0.12_Fab Light Chain

SEQ ID NO: 5845 - protein, 108 aa, Artificial Sequence; identical to SEQ ID NO: 1517
  Description of Artificial Sequence: Synthetic polypeptide
  VL of XENP020332

SEQ ID NO: 5846 - protein, 12 aa, Artificial Sequence
  Description of Artificial Sequence: Synthetic peptide
  XENP020332 vlCDR1
RASQSVGSSYLA

SEQ ID NO: 5847 - protein, 7 aa, Artificial Sequence
  Description of Artificial Sequence: Synthetic peptide
  XENP020332 vlCDR2
GAFSRAT

SEQ ID NO: 5848 - protein, 9 aa, Artificial Sequence
  Description of Artificial Sequence: Synthetic peptide
  XENP020332 vlCDR3
QQYGSSPWT

SEQ ID NO: 5849 - protein, 221 aa, Artificial Sequence
  Description of Artificial Sequence: Synthetic polypeptide
  XENP020333 [CTLA-4]_H3.19_L0.12_Fab Heavy Chain
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARGGHLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5850 - protein, 118 aa, Artificial Sequence; identical to SEQ ID NO: 2596
  Description of Artificial Sequence: Synthetic polypeptide
  VH of XENP020333

SEQ ID NO: 5851 - protein, 5 aa, Artificial Sequence
  Description of Artificial Sequence: Synthetic peptide
  XENP020333 vhCDR1
SYTMH

SEQ ID NO: 5852 - protein, 17 aa, Artificial Sequence
  Description of Artificial Sequence: Synthetic peptide
  XENP020333 vhCDR2
FISYDGNTKYYADSVKG

SEQ ID NO: 5853 - protein, 9 aa, Artificial Sequence
  Description of Artificial Sequence: Synthetic peptide
  XENP020333 vhCDR3
GGHLGPFDL

SEQ ID NO: 5854 - protein, 215 aa, Artificial Sequence; identical to SEQ ID NO: 4404
  Description of Artificial Sequence: Synthetic polypeptide
  XENP020333 [CTLA-4]_H3.19_L0.12_Fab Light Chain

SEQ ID NO: 5855 - protein, 108 aa, Artificial Sequence; identical to SEQ ID NO: 1517
  Description of Artificial Sequence: Synthetic polypeptide
  VL of XENP020333

SEQ ID NO: 5856 - protein, 12 aa, Artificial Sequence
  Description of Artificial Sequence: Synthetic peptide
  XENP020333 vlCDR1
RASQSVGSSYLA

SEQ ID NO: 5857 - protein, 7 aa, Artificial Sequence
  Description of Artificial Sequence: Synthetic peptide
  XENP020333 vlCDR2
GAFSRAT

SEQ ID NO: 5858 - protein, 9 aa, Artificial Sequence
  Description of Artificial Sequence: Synthetic peptide
  XENP020333 vlCDR3
QQYGSSPWT

SEQ ID NO: 5859 - protein, 221 aa, Artificial Sequence
  Description of Artificial Sequence: Synthetic polypeptide
  XENP020334 [CTLA-4]_H3.20_L0.12_Fab Heavy Chain
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTSHLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5860 - protein, 118 aa, Artificial Sequence; identical to SEQ ID NO: 2605
  Description of Artificial Sequence: Synthetic polypeptide
  VH of XENP020334

SEQ ID NO: 5861 - protein, 5 aa, Artificial Sequence
  Description of Artificial Sequence: Synthetic peptide
  XENP020334 vhCDR1
SYTMH

SEQ ID NO: 5862 - protein, 17 aa, Artificial Sequence
  Description of Artificial Sequence: Synthetic peptide
  XENP020334 vhCDR2
FISYDGNTKYYADSVKG

SEQ ID NO: 5863 - protein, 9 aa, Artificial Sequence
  Description of Artificial Sequence: Synthetic peptide
  XENP020334 vhCDR3
TSHLGPFDL

SEQ ID NO: 5864 - protein, 215 aa, Artificial Sequence; identical to SEQ ID NO: 4404
  Description of Artificial Sequence: Synthetic polypeptide
  XENP020334 [CTLA-4]_H3.20_L0.12_Fab Light Chain

SEQ ID NO: 5865 - protein, 108 aa, Artificial Sequence; identical to SEQ ID NO: 1517
  Description of Artificial Sequence: Synthetic polypeptide
  VL of XENP020334

SEQ ID NO: 5866 - protein, 12 aa, Artificial Sequence
  Description of Artificial Sequence: Synthetic peptide
  XENP020334 vlCDR1
RASQSVGSSYLA

SEQ ID NO: 5867 - protein, 7 aa, Artificial Sequence
  Description of Artificial Sequence: Synthetic peptide
  XENP020334 vlCDR2
GAFSRAT

SEQ ID NO: 5868 - protein, 9 aa, Artificial Sequence
  Description of Artificial Sequence: Synthetic peptide
  XENP020334 vlCDR3
QQYGSSPWT

SEQ ID NO: 5869 - protein, 221 aa, Artificial Sequence
  Description of Artificial Sequence: Synthetic polypeptide
  XENP020335 [CTLA-4]_H3.21_L0.12_Fab Heavy Chain
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARGGLLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5870 - protein, 118 aa, Artificial Sequence; identical to SEQ ID NO: 2614
  Description of Artificial Sequence: Synthetic polypeptide
  VH of XENP020335

SEQ ID NO: 5871 - protein, 5 aa, Artificial Sequence
  Description of Artificial Sequence: Synthetic peptide
  XENP020335 vhCDR1
SYTMH

SEQ ID NO: 5872 - protein, 17 aa, Artificial Sequence
  Description of Artificial Sequence: Synthetic peptide
  XENP020335 vhCDR2
FISYDGNTKYYADSVKG

SEQ ID NO: 5873 - protein, 9 aa, Artificial Sequence
  Description of Artificial Sequence: Synthetic peptide
  XENP020335 vhCDR3
GGLLGPFDL

SEQ ID NO: 5874 - protein, 215 aa, Artificial Sequence; identical to SEQ ID NO: 4404
  Description of Artificial Sequence: Synthetic polypeptide
  XENP020335 [CTLA-4]_H3.21_L0.12_Fab Light Chain

SEQ ID NO: 5875 - protein, 108 aa, Artificial Sequence; identical to SEQ ID NO: 1517
  Description of Artificial Sequence: Synthetic polypeptide
  VL of XENP020335

SEQ ID NO: 5876 - protein, 12 aa, Artificial Sequence
  Description of Artificial Sequence: Synthetic peptide
  XENP020335 vlCDR1
RASQSVGSSYLA

SEQ ID NO: 5877 - protein, 7 aa, Artificial Sequence
  Description of Artificial Sequence: Synthetic peptide
  XENP020335 vlCDR2
GAFSRAT

SEQ ID NO: 5878 - protein, 9 aa, Artificial Sequence
  Description of Artificial Sequence: Synthetic peptide
  XENP020335 vlCDR3
QQYGSSPWT

SEQ ID NO: 5879 - protein, 221 aa, Artificial Sequence
  Description of Artificial Sequence: Synthetic polypeptide
  XENP020336 [CTLA-4]_H3.22_L0.12_Fab Heavy Chain
EVQLVESGGGLVKPGGSLRLSCAASGFTFSSYTMHWVRQAPGKGLEWVSFISYDGNTKYYADSVKGRFTISRDNAKNSLYLQMNSLRAEDTAVYYCARTSLLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5880 - protein, 118 aa, Artificial Sequence; identical to SEQ ID NO: 2623
  Description of Artificial Sequence: Synthetic polypeptide
  VH of XENP020336

SEQ ID NO: 5881 - protein, 5 aa, Artificial Sequence
  Description of Artificial Sequence: Synthetic peptide
  XENP020336 vhCDR1
SYTMH

SEQ ID NO: 5882 - protein, 17 aa, Artificial Sequence
  Description of Artificial Sequence: Synthetic peptide
  XENP020336 vhCDR2
FISYDGNTKYYADSVKG

SEQ ID NO: 5883 - protein, 9 aa, Artificial Sequence
  Description of Artificial Sequence: Synthetic peptide
  XENP020336 vhCDR3
TSLLGPFDL

SEQ ID NO: 5884 - protein, 215 aa, Artificial Sequence; identical to SEQ ID NO: 4404
  Description of Artificial Sequence: Synthetic polypeptide
  XENP020336 [CTLA-4]_H3.22_L0.12_Fab Light Chain

SEQ ID NO: 5885 - protein, 108 aa, Artificial Sequence; identical to SEQ ID NO: 1517
  Description of Artificial Sequence: Synthetic polypeptide
  VL of XENP020336

SEQ ID NO: 5886 - protein, 12 aa, Artificial Sequence
  Description of Artificial Sequence: Synthetic peptide
  XENP020336 vlCDR1
RASQSVGSSYLA

SEQ ID NO: 5887 - protein, 7 aa, Artificial Sequence
  Description of Artificial Sequence: Synthetic peptide
  XENP020336 vlCDR2
GAFSRAT

SEQ ID NO: 5888 - protein, 9 aa, Artificial Sequence
  Description of Artificial Sequence: Synthetic peptide
  XENP020336 vlCDR3
QQYGSSPWT

SEQ ID NO: 5889 - protein, 221 aa, Artificial Sequence
  Description of Artificial Sequence: Synthetic polypeptide
  XENP020337 [CTLA-4]_H3.23_L0.12_Fab Heavy Chain
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGHLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5890 - protein, 118 aa, Artificial Sequence; identical to SEQ ID NO: 2632
  Description of Artificial Sequence: Synthetic polypeptide
  VH of XENP020337

SEQ ID NO: 5891 - protein, 5 aa, Artificial Sequence
  Description of Artificial Sequence: Synthetic peptide
  XENP020337 vhCDR1
SYTMH

SEQ ID NO: 5892 - protein, 17 aa, Artificial Sequence
  Description of Artificial Sequence: Synthetic peptide
  XENP020337 vhCDR2
FISYDGNYKYYADSVKG

SEQ ID NO: 5893 - protein, 9 aa, Artificial Sequence
  Description of Artificial Sequence: Synthetic peptide
  XENP020337 vhCDR3
GGHLGPFDL

SEQ ID NO: 5894 - protein, 215 aa, Artificial Sequence; identical to SEQ ID NO: 4404
  Description of Artificial Sequence: Synthetic polypeptide
  XENP020337 [CTLA-4]_H3.23_L0.12_Fab Light Chain

SEQ ID NO: 5895 - protein, 108 aa, Artificial Sequence; identical to SEQ ID NO: 1517
  Description of Artificial Sequence: Synthetic polypeptide
  VL of XENP020337

SEQ ID NO: 5896 - protein, 12 aa, Artificial Sequence
  Description of Artificial Sequence: Synthetic peptide
  XENP020337 vlCDR1
RASQSVGSSYLA

SEQ ID NO: 5897 - protein, 7 aa, Artificial Sequence
  Description of Artificial Sequence: Synthetic peptide
  XENP020337 vlCDR2
GAFSRAT

SEQ ID NO: 5898 - protein, 9 aa, Artificial Sequence
  Description of Artificial Sequence: Synthetic peptide
  XENP020337 vlCDR3
QQYGSSPWT

SEQ ID NO: 5899 - protein, 221 aa, Artificial Sequence
  Description of Artificial Sequence: Synthetic polypeptide
  XENP020338 [CTLA-4]_H3.24_L0.12_Fab Heavy Chain
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARTSHLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5900 - protein, 118 aa, Artificial Sequence; identical to SEQ ID NO: 2641
  Description of Artificial Sequence: Synthetic polypeptide
  VH of XENP020338

SEQ ID NO: 5901 - protein, 5 aa, Artificial Sequence
  Description of Artificial Sequence: Synthetic peptide
  XENP020338 vhCDR1
SYTMH

SEQ ID NO: 5902 - protein, 17 aa, Artificial Sequence
  Description of Artificial Sequence: Synthetic peptide
  XENP020338 vhCDR2
FISYDGNYKYYADSVKG

SEQ ID NO: 5903 - protein, 9 aa, Artificial Sequence
  Description of Artificial Sequence: Synthetic peptide
  XENP020338 vhCDR3
TSHLGPFDL

SEQ ID NO: 5904 - protein, 215 aa, Artificial Sequence; identical to SEQ ID NO: 4404
  Description of Artificial Sequence: Synthetic polypeptide
  XENP020338 [CTLA-4]_H3.24_L0.12_Fab Light Chain

SEQ ID NO: 5905 - protein, 108 aa, Artificial Sequence; identical to SEQ ID NO: 1517
  Description of Artificial Sequence: Synthetic polypeptide
  VL of XENP020338

SEQ ID NO: 5906 - protein, 12 aa, Artificial Sequence
  Description of Artificial Sequence: Synthetic peptide
  XENP020338 vlCDR1
RASQSVGSSYLA

SEQ ID NO: 5907 - protein, 7 aa, Artificial Sequence
  Description of Artificial Sequence: Synthetic peptide
  XENP020338 vlCDR2
GAFSRAT

SEQ ID NO: 5908 - protein, 9 aa, Artificial Sequence
  Description of Artificial Sequence: Synthetic peptide
  XENP020338 vlCDR3
QQYGSSPWT

SEQ ID NO: 5909 - protein, 221 aa, Artificial Sequence
  Description of Artificial Sequence: Synthetic polypeptide
  XENP020339 [CTLA-4]_H3.25_L0.12_Fab Heavy Chain
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARGGLLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5910 - protein, 118 aa, Artificial Sequence; identical to SEQ ID NO: 2650
  Description of Artificial Sequence: Synthetic polypeptide
  VH of XENP020339

SEQ ID NO: 5911 - protein, 5 aa, Artificial Sequence
  Description of Artificial Sequence: Synthetic peptide
  XENP020339 vhCDR1
SYTMH

SEQ ID NO: 5912 - protein, 17 aa, Artificial Sequence
  Description of Artificial Sequence: Synthetic peptide
  XENP020339 vhCDR2
FISYDGNYKYYADSVKG

SEQ ID NO: 5913 - protein, 9 aa, Artificial Sequence
  Description of Artificial Sequence: Synthetic peptide
  XENP020339 vhCDR3
GGLLGPFDL

SEQ ID NO: 5914 - protein, 215 aa, Artificial Sequence; identical to SEQ ID NO: 4404
  Description of Artificial Sequence: Synthetic polypeptide
  XENP020339 [CTLA-4]_H3.25_L0.12_Fab Light Chain

SEQ ID NO: 5915 - protein, 108 aa, Artificial Sequence; identical to SEQ ID NO: 1517
  Description of Artificial Sequence: Synthetic polypeptide
  VL of XENP020339

SEQ ID NO: 5916 - protein, 12 aa, Artificial Sequence
  Description of Artificial Sequence: Synthetic peptide
  XENP020339 vlCDR1
RASQSVGSSYLA

SEQ ID NO: 5917 - protein, 7 aa, Artificial Sequence
  Description of Artificial Sequence: Synthetic peptide
  XENP020339 vlCDR2
GAFSRAT

SEQ ID NO: 5918 - protein, 9 aa, Artificial Sequence
  Description of Artificial Sequence: Synthetic peptide
  XENP020339 vlCDR3
QQYGSSPWT

SEQ ID NO: 5919 - protein, 221 aa, Artificial Sequence
  Description of Artificial Sequence: Synthetic polypeptide
  XENP020340 [CTLA-4]_H3.26_L0.12_Fab Heavy Chain
EVQLVESGGGLVKPGGSLRLSCAASGFTFSSYTMHWVRQAPGKGLEWVSFISYDGNYKYYADSVKGRFTISRDNAKNSLYLQMNSLRAEDTAVYYCARTSLLGPFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5920 - protein, 118 aa, Artificial Sequence; identical to SEQ ID NO: 2659
  Description of Artificial Sequence: Synthetic polypeptide
  VH of XENP020340

SEQ ID NO: 5921 - protein, 5 aa, Artificial Sequence
  Description of Artificial Sequence: Synthetic peptide
  XENP020340 vhCDR1
SYTMH

SEQ ID NO: 5922 - protein, 17 aa, Artificial Sequence
  Description of Artificial Sequence: Synthetic peptide
  XENP020340 vhCDR2
FISYDGNYKYYADSVKG

SEQ ID NO: 5923 - protein, 9 aa, Artificial Sequence
  Description of Artificial Sequence: Synthetic peptide
  XENP020340 vhCDR3
TSLLGPFDL

SEQ ID NO: 5924 - protein, 215 aa, Artificial Sequence; identical to SEQ ID NO: 4404
  Description of Artificial Sequence: Synthetic polypeptide
  XENP020340 [CTLA-4]_H3.26_L0.12_Fab Light Chain

SEQ ID NO: 5925 - protein, 108 aa, Artificial Sequence; identical to SEQ ID NO: 1517
  Description of Artificial Sequence: Synthetic polypeptide
  VL of XENP020340

SEQ ID NO: 5926 - protein, 12 aa, Artificial Sequence
  Description of Artificial Sequence: Synthetic peptide
  XENP020340 vlCDR1
RASQSVGSSYLA

SEQ ID NO: 5927 - protein, 7 aa, Artificial Sequence
  Description of Artificial Sequence: Synthetic peptide
  XENP020340 vlCDR2
GAFSRAT

SEQ ID NO: 5928 - protein, 9 aa, Artificial Sequence
  Description of Artificial Sequence: Synthetic peptide
  XENP020340 vlCDR3
QQYGSSPWT

SEQ ID NO: 5929 - protein, 221 aa, Artificial Sequence; identical to SEQ ID NO: 5709
  Description of Artificial Sequence: Synthetic polypeptide
  XENP020341 [CTLA-4]_H3.4_L0.118_Fab Heavy Chain

SEQ ID NO: 5930 - protein, 118 aa, Artificial Sequence; identical to SEQ ID NO: 2461
  Description of Artificial Sequence: Synthetic polypeptide
  VH of XENP020341

SEQ ID NO: 5931 - protein, 5 aa, Artificial Sequence
  Description of Artificial Sequence: Synthetic peptide
  XENP020341 vhCDR1
SYTMH

SEQ ID NO: 5932 - protein, 17 aa, Artificial Sequence
  Description of Artificial Sequence: Synthetic peptide
  XENP020341 vhCDR2
FISYDGNHKYYADSVKG

SEQ ID NO: 5933 - protein, 9 aa, Artificial Sequence
  Description of Artificial Sequence: Synthetic peptide
  XENP020341 vhCDR3
TGHLGPFDL

SEQ ID NO: 5934 - protein, 215 aa, Artificial Sequence
  Description of Artificial Sequence: Synthetic polypeptide
  XENP020341 [CTLA-4]_H3.4_L0.118_Fab Light Chain
EIVLTQSPATLSVSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5935 - protein, 108 aa, Artificial Sequence; identical to SEQ ID NO: 2669
  Description of Artificial Sequence: Synthetic polypeptide
  VL of XENP020341

SEQ ID NO: 5936 - protein, 12 aa, Artificial Sequence
  Description of Artificial Sequence: Synthetic peptide
  XENP020341 vlCDR1
RASQSVGSSYLA

SEQ ID NO: 5937 - protein, 7 aa, Artificial Sequence
  Description of Artificial Sequence: Synthetic peptide
  XENP020341 vlCDR2
GAFSRAT

SEQ ID NO: 5938 - protein, 9 aa, Artificial Sequence
  Description of Artificial Sequence: Synthetic peptide
  XENP020341 vlCDR3
QQYGSSPWT

SEQ ID NO: 5939 - protein, 221 aa, Artificial Sequence; identical to SEQ ID NO: 5709
  Description of Artificial Sequence: Synthetic polypeptide
  XENP020342 [CTLA-4]_H3.4_L0.119_Fab Heavy Chain

SEQ ID NO: 5940 - protein, 118 aa, Artificial Sequence; identical to SEQ ID NO: 2461
  Description of Artificial Sequence: Synthetic polypeptide
  VH of XENP020342

SEQ ID NO: 5941 - protein, 5 aa, Artificial Sequence
  Description of Artificial Sequence: Synthetic peptide
  XENP020342 vhCDR1
SYTMH

SEQ ID NO: 5942 - protein, 17 aa, Artificial Sequence
  Description of Artificial Sequence: Synthetic peptide
  XENP020342 vhCDR2
FISYDGNHKYYADSVKG

SEQ ID NO: 5943 - protein, 9 aa, Artificial Sequence
  Description of Artificial Sequence: Synthetic peptide
  XENP020342 vhCDR3
TGHLGPFDL

SEQ ID NO: 5944 - protein, 215 aa, Artificial Sequence; identical to SEQ ID NO: 2924
  Description of Artificial Sequence: Synthetic polypeptide
  XENP020342 [CTLA-4]_H3.4_L0.119_Fab Light Chain

SEQ ID NO: 5945 - protein, 108 aa, Artificial Sequence; identical to SEQ ID NO: 23
  Description of Artificial Sequence: Synthetic polypeptide
  VL of XENP020342

SEQ ID NO: 5946 - protein, 12 aa, Artificial Sequence
  Description of Artificial Sequence: Synthetic peptide
  XENP020342 vlCDR1
RASQSVGSSYLA

SEQ ID NO: 5947 - protein, 7 aa, Artificial Sequence
  Description of Artificial Sequence: Synthetic peptide
  XENP020342 vlCDR2
GAFSRAT

SEQ ID NO: 5948 - protein, 9 aa, Artificial Sequence
  Description of Artificial Sequence: Synthetic peptide
  XENP020342 vlCDR3
QQYGSSPWT

SEQ ID NO: 5949 - protein, 221 aa, Artificial Sequence; identical to SEQ ID NO: 5709
  Description of Artificial Sequence: Synthetic polypeptide
  XENP020343 [CTLA-4]_H3.4_L0.120_Fab Heavy Chain

SEQ ID NO: 5950 - protein, 118 aa, Artificial Sequence; identical to SEQ ID NO: 2461
  Description of Artificial Sequence: Synthetic polypeptide
  VH of XENP020343

SEQ ID NO: 5951 - protein, 5 aa, Artificial Sequence
  Description of Artificial Sequence: Synthetic peptide
  XENP020343 vhCDR1
SYTMH

SEQ ID NO: 5952 - protein, 17 aa, Artificial Sequence
  Description of Artificial Sequence: Synthetic peptide
  XENP020343 vhCDR2
FISYDGNHKYYADSVKG

SEQ ID NO: 5953 - protein, 9 aa, Artificial Sequence
  Description of Artificial Sequence: Synthetic peptide
  XENP020343 vhCDR3
TGHLGPFDL

SEQ ID NO: 5954 - protein, 215 aa, Artificial Sequence
  Description of Artificial Sequence: Synthetic polypeptide
  XENP020343 [CTLA-4]_H3.4_L0.120_Fab Light Chain
EIVLTQSPGTLSVSPGERATLSCRASQSVSSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5955 - protein, 108 aa, Artificial Sequence; identical to SEQ ID NO: 2687
  Description of Artificial Sequence: Synthetic polypeptide
  VL of XENP020343

SEQ ID NO: 5956 - protein, 12 aa, Artificial Sequence
  Description of Artificial Sequence: Synthetic peptide
  XENP020343 vlCDR1
RASQSVSSSYLA

SEQ ID NO: 5957 - protein, 7 aa, Artificial Sequence
  Description of Artificial Sequence: Synthetic peptide
  XENP020343 vlCDR2
GAFSRAT

SEQ ID NO: 5958 - protein, 9 aa, Artificial Sequence
  Description of Artificial Sequence: Synthetic peptide
  XENP020343 vlCDR3
QQYGSSPWT

SEQ ID NO: 5959 - protein, 221 aa, Artificial Sequence; identical to SEQ ID NO: 5709
  Description of Artificial Sequence: Synthetic polypeptide
  XENP020344 [CTLA-4]_H3.4_L0.121_Fab Heavy Chain

SEQ ID NO: 5960 - protein, 118 aa, Artificial Sequence; identical to SEQ ID NO: 2461
  Description of Artificial Sequence: Synthetic polypeptide
  VH of XENP020344

SEQ ID NO: 5961 - protein, 5 aa, Artificial Sequence
  Description of Artificial Sequence: Synthetic peptide
  XENP020344 vhCDR1
SYTMH

SEQ ID NO: 5962 - protein, 17 aa, Artificial Sequence
  Description of Artificial Sequence: Synthetic peptide
  XENP020344 vhCDR2
FISYDGNHKYYADSVKG

SEQ ID NO: 5963 - protein, 9 aa, Artificial Sequence
  Description of Artificial Sequence: Synthetic peptide
  XENP020344 vhCDR3
TGHLGPFDL

SEQ ID NO: 5964 - protein, 215 aa, Artificial Sequence
  Description of Artificial Sequence: Synthetic polypeptide
  XENP020344 [CTLA-4]_H3.4_L0.121_Fab Light Chain
EIVLTQSPGTLSVSPGERATLSCRASQSVGSSYLAWYQQKPGQAPRLLIYGASSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5965 - protein, 108 aa, Artificial Sequence; identical to SEQ ID NO: 2696
  Description of Artificial Sequence: Synthetic polypeptide
  VL of XENP020344

SEQ ID NO: 5966 - protein, 12 aa, Artificial Sequence
  Description of Artificial Sequence: Synthetic peptide
  XENP020344 vlCDR1
RASQSVGSSYLA

SEQ ID NO: 5967 - protein, 7 aa, Artificial Sequence
  Description of Artificial Sequence: Synthetic peptide
  XENP020344 vlCDR2
GASSRAT

SEQ ID NO: 5968 - protein, 9 aa, Artificial Sequence
  Description of Artificial Sequence: Synthetic peptide
  XENP020344 vlCDR3
QQYGSSPWT

SEQ ID NO: 5969 - protein, 221 aa, Artificial Sequence; identical to SEQ ID NO: 5709
  Description of Artificial Sequence: Synthetic polypeptide
  XENP020345 [CTLA-4]_H3.4_L0.122_Fab Heavy Chain

SEQ ID NO: 5970 - protein, 118 aa, Artificial Sequence; identical to SEQ ID NO: 2461
  Description of Artificial Sequence: Synthetic polypeptide
  VH of XENP020345

SEQ ID NO: 5971 - protein, 5 aa, Artificial Sequence
  Description of Artificial Sequence: Synthetic peptide
  XENP020345 vhCDR1
SYTMH

SEQ ID NO: 5972 - protein, 17 aa, Artificial Sequence
  Description of Artificial Sequence: Synthetic peptide
  XENP020345 vhCDR2
FISYDGNHKYYADSVKG

SEQ ID NO: 5973 - protein, 9 aa, Artificial Sequence
  Description of Artificial Sequence: Synthetic peptide
  XENP020345 vhCDR3
TGHLGPFDL

SEQ ID NO: 5974 - protein, 215 aa, Artificial Sequence; identical to SEQ ID NO: 4364
  Description of Artificial Sequence: Synthetic polypeptide
  XENP020345 [CTLA-4]_H3.4_L0.122_Fab Light Chain

SEQ ID NO: 5975 - protein, 108 aa, Artificial Sequence; identical to SEQ ID NO: 1481
  Description of Artificial Sequence: Synthetic polypeptide
  VL of XENP020345

SEQ ID NO: 5976 - protein, 12 aa, Artificial Sequence
  Description of Artificial Sequence: Synthetic peptide
  XENP020345 vlCDR1
RASQSVGSSYLA

SEQ ID NO: 5977 - protein, 7 aa, Artificial Sequence
  Description of Artificial Sequence: Synthetic peptide
  XENP020345 vlCDR2
GAFSRAT

SEQ ID NO: 5978 - protein, 9 aa, Artificial Sequence
  Description of Artificial Sequence: Synthetic peptide
  XENP020345 vlCDR3
QQYGSSPWT

SEQ ID NO: 5979 - protein, 221 aa, Artificial Sequence; identical to SEQ ID NO: 5709
  Description of Artificial Sequence: Synthetic polypeptide
  XENP020346 [CTLA-4]_H3.4_L0.123_Fab Heavy Chain

SEQ ID NO: 5980 - protein, 118 aa, Artificial Sequence; identical to SEQ ID NO: 2461
  Description of Artificial Sequence: Synthetic polypeptide
  VH of XENP020346

SEQ ID NO: 5981 - protein, 5 aa, Artificial Sequence
  Description of Artificial Sequence: Synthetic peptide
  XENP020346 vhCDR1
SYTMH

SEQ ID NO: 5982 - protein, 17 aa, Artificial Sequence
  Description of Artificial Sequence: Synthetic peptide
  XENP020346 vhCDR2
FISYDGNHKYYADSVKG

SEQ ID NO: 5983 - protein, 9 aa, Artificial Sequence
  Description of Artificial Sequence: Synthetic peptide
  XENP020346 vhCDR3
TGHLGPFDL

SEQ ID NO: 5984 - protein, 215 aa, Artificial Sequence
  Description of Artificial Sequence: Synthetic polypeptide
  XENP020346 [CTLA-4]_H3.4_L0.123_Fab Light Chain
EIVLTQSPATLSVSPGERATLSCRASQSVSSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5985 - protein, 108 aa, Artificial Sequence; identical to SEQ ID NO: 2714
  Description of Artificial Sequence: Synthetic polypeptide
  VL of XENP020346

SEQ ID NO: 5986 - protein, 12 aa, Artificial Sequence
  Description of Artificial Sequence: Synthetic peptide
  XENP020346 vlCDR1
RASQSVSSSYLA

SEQ ID NO: 5987 - protein, 7 aa, Artificial Sequence
  Description of Artificial Sequence: Synthetic peptide
  XENP020346 vlCDR2
GAFSRAT

SEQ ID NO: 5988 - protein, 9 aa, Artificial Sequence
  Description of Artificial Sequence: Synthetic peptide
  XENP020346 vlCDR3
QQYGSSPWT

SEQ ID NO: 5989 - protein, 221 aa, Artificial Sequence; identical to SEQ ID NO: 5709
  Description of Artificial Sequence: Synthetic polypeptide
  XENP020347 [CTLA-4]_H3.4_L0.124_Fab Heavy Chain

SEQ ID NO: 5990 - protein, 118 aa, Artificial Sequence; identical to SEQ ID NO: 2461
  Description of Artificial Sequence: Synthetic polypeptide
  VH of XENP020347

SEQ ID NO: 5991 - protein, 5 aa, Artificial Sequence
  Description of Artificial Sequence: Synthetic peptide
  XENP020347 vhCDR1
SYTMH

SEQ ID NO: 5992 - protein, 17 aa, Artificial Sequence
  Description of Artificial Sequence: Synthetic peptide
  XENP020347 vhCDR2
FISYDGNHKYYADSVKG

SEQ ID NO: 5993 - protein, 9 aa, Artificial Sequence
  Description of Artificial Sequence: Synthetic peptide
  XENP020347 vhCDR3
TGHLGPFDL

SEQ ID NO: 5994 - protein, 215 aa, Artificial Sequence
  Description of Artificial Sequence: Synthetic polypeptide
  XENP020347 [CTLA-4]_H3.4_L0.124_Fab Light Chain
EIVLTQSPATLSVSPGERATLSCRASQSVGSSYLAWYQQKPGQAPRLLIYGASSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5995 - protein, 108 aa, Artificial Sequence; identical to SEQ ID NO: 2723
  Description of Artificial Sequence: Synthetic polypeptide
  VL of XENP020347

SEQ ID NO: 5996 - protein, 12 aa, Artificial Sequence
  Description of Artificial Sequence: Synthetic peptide
  XENP020347 vlCDR1
RASQSVGSSYLA

SEQ ID NO: 5997 - protein, 7 aa, Artificial Sequence
  Description of Artificial Sequence: Synthetic peptide
  XENP020347 vlCDR2
GASSRAT

SEQ ID NO: 5998 - protein, 9 aa, Artificial Sequence
  Description of Artificial Sequence: Synthetic peptide
  XENP020347 vlCDR3
QQYGSSPWT

SEQ ID NO: 5999 - protein, 221 aa, Artificial Sequence; identical to SEQ ID NO: 5709
  Description of Artificial Sequence: Synthetic polypeptide
  XENP020348 [CTLA-4]_H3.4_L0.125_Fab Heavy Chain

SEQ ID NO: 6000 - protein, 118 aa, Artificial Sequence; identical to SEQ ID NO: 2461
  Description of Artificial Sequence: Synthetic polypeptide
  VH of XENP020348

SEQ ID NO: 6001 - protein, 5 aa, Artificial Sequence
  Description of Artificial Sequence: Synthetic peptide
  XENP020348 vhCDR1
SYTMH

SEQ ID NO: 6002 - protein, 17 aa, Artificial Sequence
  Description of Artificial Sequence: Synthetic peptide
  XENP020348 vhCDR2
FISYDGNHKYYADSVKG

SEQ ID NO: 6003 - protein, 9 aa, Artificial Sequence
  Description of Artificial Sequence: Synthetic peptide
  XENP020348 vhCDR3
TGHLGPFDL

SEQ ID NO: 6004 - protein, 215 aa, Artificial Sequence; identical to SEQ ID NO: 4504
  Description of Artificial Sequence: Synthetic polypeptide
  XENP020348 [CTLA-4]_H3.4_L0.125_Fab Light Chain

SEQ ID NO: 6005 - protein, 108 aa, Artificial Sequence; identical to SEQ ID NO: 1607
  Description of Artificial Sequence: Synthetic polypeptide
  VL of XENP020348

SEQ ID NO: 6006 - protein, 12 aa, Artificial Sequence
  Description of Artificial Sequence: Synthetic peptide
  XENP020348 vlCDR1
RASQSVSSSYLA

SEQ ID NO: 6007 - protein, 7 aa, Artificial Sequence
  Description of Artificial Sequence: Synthetic peptide
  XENP020348 vlCDR2
GAFSRAT

SEQ ID NO: 6008 - protein, 9 aa, Artificial Sequence
  Description of Artificial Sequence: Synthetic peptide
  XENP020348 vlCDR3
QQYGSSPWT

SEQ ID NO: 6009 - protein, 221 aa, Artificial Sequence; identical to SEQ ID NO: 5709
  Description of Artificial Sequence: Synthetic polypeptide
  XENP020349 [CTLA-4]_H3.4_L0.126_Fab Heavy Chain

SEQ ID NO: 6010 - protein, 118 aa, Artificial Sequence; identical to SEQ ID NO: 2461
  Description of Artificial Sequence: Synthetic polypeptide
  VH of XENP020349

SEQ ID NO: 6011 - protein, 5 aa, Artificial Sequence
  Description of Artificial Sequence: Synthetic peptide
  XENP020349 vhCDR1
SYTMH

SEQ ID NO: 6012 - protein, 17 aa, Artificial Sequence
  Description of Artificial Sequence: Synthetic peptide
  XENP020349 vhCDR2
FISYDGNHKYYADSVKG

SEQ ID NO: 6013 - protein, 9 aa, Artificial Sequence
  Description of Artificial Sequence: Synthetic peptide
  XENP020349 vhCDR3
TGHLGPFDL

SEQ ID NO: 6014 - protein, 215 aa, Artificial Sequence; identical to SEQ ID NO: 5014
  Description of Artificial Sequence: Synthetic polypeptide
  XENP020349 [CTLA-4]_H3.4_L0.126_Fab Light Chain

SEQ ID NO: 6015 - protein, 108 aa, Artificial Sequence; identical to SEQ ID NO: 2066
  Description of Artificial Sequence: Synthetic polypeptide
  VL of XENP020349

SEQ ID NO: 6016 - protein, 12 aa, Artificial Sequence
  Description of Artificial Sequence: Synthetic peptide
  XENP020349 vlCDR1
RASQSVGSSYLA

SEQ ID NO: 6017 - protein, 7 aa, Artificial Sequence
  Description of Artificial Sequence: Synthetic peptide
  XENP020349 vlCDR2
GASSRAT

SEQ ID NO: 6018 - protein, 9 aa, Artificial Sequence
  Description of Artificial Sequence: Synthetic peptide
  XENP020349 vlCDR3
QQYGSSPWT

SEQ ID NO: 6019 - protein, 221 aa, Artificial Sequence; identical to SEQ ID NO: 5709
  Description of Artificial Sequence: Synthetic polypeptide
  XENP020350 [CTLA-4]_H3.4_L0.127_Fab Heavy Chain

SEQ ID NO: 6020 - protein, 118 aa, Artificial Sequence; identical to SEQ ID NO: 2461
  Description of Artificial Sequence: Synthetic polypeptide
  VH of XENP020350

SEQ ID NO: 6021 - protein, 5 aa, Artificial Sequence
  Description of Artificial Sequence: Synthetic peptide
  XENP020350 vhCDR1
SYTMH

SEQ ID NO: 6022 - protein, 17 aa, Artificial Sequence
  Description of Artificial Sequence: Synthetic peptide
  XENP020350 vhCDR2
FISYDGNHKYYADSVKG

SEQ ID NO: 6023 - protein, 9 aa, Artificial Sequence
  Description of Artificial Sequence: Synthetic peptide
  XENP020350 vhCDR3
TGHLGPFDL

SEQ ID NO: 6024 - protein, 215 aa, Artificial Sequence
  Description of Artificial Sequence: Synthetic polypeptide
  XENP020350 [CTLA-4]_H3.4_L0.127_Fab Light Chain
EIVLTQSPGTLSVSPGERATLSCRASQSVSSSYLAWYQQKPGQAPRLLIYGASSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 6025 - protein, 108 aa, Artificial Sequence; identical to SEQ ID NO: 2750
  Description of Artificial Sequence: Synthetic polypeptide
  VL of XENP020350

SEQ ID NO: 6026 - protein, 12 aa, Artificial Sequence
  Description of Artificial Sequence: Synthetic peptide
  XENP020350 vlCDR1
RASQSVSSSYLA

SEQ ID NO: 6027 - protein, 7 aa, Artificial Sequence
  Description of Artificial Sequence: Synthetic peptide
  XENP020350 vlCDR2
GASSRAT

SEQ ID NO: 6028 - protein, 9 aa, Artificial Sequence
  Description of Artificial Sequence: Synthetic peptide
  XENP020350 vlCDR3
QQYGSSPWT

SEQ ID NO: 6029 - protein, 221 aa, Artificial Sequence; identical to SEQ ID NO: 5709
  Description of Artificial Sequence: Synthetic polypeptide
  XENP020351 [CTLA-4]_H3.4_L0.128_Fab Heavy Chain

SEQ ID NO: 6030 - protein, 118 aa, Artificial Sequence; identical to SEQ ID NO: 2461
  Description of Artificial Sequence: Synthetic polypeptide
  VH of XENP020351

SEQ ID NO: 6031 - protein, 5 aa, Artificial Sequence
  Description of Artificial Sequence: Synthetic peptide
  XENP020351 vhCDR1
SYTMH

SEQ ID NO: 6032 - protein, 17 aa, Artificial Sequence
  Description of Artificial Sequence: Synthetic peptide
  XENP020351 vhCDR2
FISYDGNHKYYADSVKG

SEQ ID NO: 6033 - protein, 9 aa, Artificial Sequence
  Description of Artificial Sequence: Synthetic peptide
  XENP020351 vhCDR3
TGHLGPFDL

SEQ ID NO: 6034 - protein, 215 aa, Artificial Sequence
  Description of Artificial Sequence: Synthetic polypeptide
  XENP020351 [CTLA-4]_H3.4_L0.128_Fab Light Chain
EIVLTQSPATLSLSPGERATLSCRASQSVSSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 6035 - protein, 108 aa, Artificial Sequence; identical to SEQ ID NO: 2759
  Description of Artificial Sequence: Synthetic polypeptide
  VL of XENP020351

SEQ ID NO: 6036 - protein, 12 aa, Artificial Sequence
  Description of Artificial Sequence: Synthetic peptide
  XENP020351 vlCDR1
RASQSVSSSYLA

SEQ ID NO: 6037 - protein, 7 aa, Artificial Sequence
  Description of Artificial Sequence: Synthetic peptide
  XENP020351 vlCDR2
GAFSRAT

SEQ ID NO: 6038 - protein, 9 aa, Artificial Sequence
  Description of Artificial Sequence: Synthetic peptide
  XENP020351 vlCDR3
QQYGSSPWT

SEQ ID NO: 6039 - protein, 221 aa, Artificial Sequence; identical to SEQ ID NO: 5709
  Description of Artificial Sequence: Synthetic polypeptide
  XENP020352 [CTLA-4]_H3.4_L0.129_Fab Heavy Chain

SEQ ID NO: 6040 - protein, 118 aa, Artificial Sequence; identical to SEQ ID NO: 2461
  Description of Artificial Sequence: Synthetic polypeptide
  VH of XENP020352

SEQ ID NO: 6041 - protein, 5 aa, Artificial Sequence
  Description of Artificial Sequence: Synthetic peptide
  XENP020352 vhCDR1
SYTMH

SEQ ID NO: 6042 - protein, 17 aa, Artificial Sequence
  Description of Artificial Sequence: Synthetic peptide
  XENP020352 vhCDR2
FISYDGNHKYYADSVKG

SEQ ID NO: 6043 - protein, 9 aa, Artificial Sequence
  Description of Artificial Sequence: Synthetic peptide
  XENP020352 vhCDR3
TGHLGPFDL

SEQ ID NO: 6044 - protein, 215 aa, Artificial Sequence
  Description of Artificial Sequence: Synthetic polypeptide
  XENP020352 [CTLA-4]_H3.4_L0.129_Fab Light Chain
EIVLTQSPATLSLSPGERATLSCRASQSVGSSYLAWYQQKPGQAPRLLIYGASSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 6045 - protein, 108 aa, Artificial Sequence; identical to SEQ ID NO: 2768
  Description of Artificial Sequence: Synthetic polypeptide
  VL of XENP020352

SEQ ID NO: 6046 - protein, 12 aa, Artificial Sequence
  Description of Artificial Sequence: Synthetic peptide
  XENP020352 vlCDR1
RASQSVGSSYLA

SEQ ID NO: 6047 - protein, 7 aa, Artificial Sequence
  Description of Artificial Sequence: Synthetic peptide
  XENP020352 vlCDR2
GASSRAT

SEQ ID NO: 6048 - protein, 9 aa, Artificial Sequence
  Description of Artificial Sequence: Synthetic peptide
  XENP020352 vlCDR3
QQYGSSPWT

SEQ ID NO: 6049 - protein, 221 aa, Artificial Sequence; identical to SEQ ID NO: 5709
  Description of Artificial Sequence: Synthetic polypeptide
  XENP020353 [CTLA-4]_H3.4_L0.130_Fab Heavy Chain

SEQ ID NO: 6050 - protein, 118 aa, Artificial Sequence; identical to SEQ ID NO: 2461
  Description of Artificial Sequence: Synthetic polypeptide
  VH of XENP020353

SEQ ID NO: 6051 - protein, 5 aa, Artificial Sequence
  Description of Artificial Sequence: Synthetic peptide
  XENP020353 vhCDR1
SYTMH

SEQ ID NO: 6052 - protein, 17 aa, Artificial Sequence
  Description of Artificial Sequence: Synthetic peptide
  XENP020353 vhCDR2
FISYDGNHKYYADSVKG

SEQ ID NO: 6053 - protein, 9 aa, Artificial Sequence
  Description of Artificial Sequence: Synthetic peptide
  XENP020353 vhCDR3
TGHLGPFDL

SEQ ID NO: 6054 - protein, 215 aa, Artificial Sequence
  Description of Artificial Sequence: Synthetic polypeptide
  XENP020353 [CTLA-4]_H3.4_L0.130_Fab Light Chain
EIVLTQSPATLSVSPGERATLSCRASQSVSSSYLAWYQQKPGQAPRLLIYGASSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 6055 - protein, 108 aa, Artificial Sequence; identical to SEQ ID NO: 2777
  Description of Artificial Sequence: Synthetic polypeptide
  VL of XENP020353

SEQ ID NO: 6056 - protein, 12 aa, Artificial Sequence
  Description of Artificial Sequence: Synthetic peptide
  XENP020353 vlCDR1
RASQSVSSSYLA

SEQ ID NO: 6057 - protein, 7 aa, Artificial Sequence
  Description of Artificial Sequence: Synthetic peptide
  XENP020353 vlCDR2
GASSRAT

SEQ ID NO: 6058 - protein, 9 aa, Artificial Sequence
  Description of Artificial Sequence: Synthetic peptide
  XENP020353 vlCDR3
QQYGSSPWT

SEQ ID NO: 6059 - protein, 221 aa, Artificial Sequence; identical to SEQ ID NO: 5709
  Description of Artificial Sequence: Synthetic polypeptide
  XENP020354 [CTLA-4]_H3.4_L0.131_Fab Heavy Chain

SEQ ID NO: 6060 - protein, 118 aa, Artificial Sequence; identical to SEQ ID NO: 2461
  Description of Artificial Sequence: Synthetic polypeptide
  VH of XENP020354

SEQ ID NO: 6061 - protein, 5 aa, Artificial Sequence
  Description of Artificial Sequence: Synthetic peptide
  XENP020354 vhCDR1
SYTMH

SEQ ID NO: 6062 - protein, 17 aa, Artificial Sequence
  Description of Artificial Sequence: Synthetic peptide
  XENP020354 vhCDR2
FISYDGNHKYYADSVKG

SEQ ID NO: 6063 - protein, 9 aa, Artificial Sequence
  Description of Artificial Sequence: Synthetic peptide
  XENP020354 vhCDR3
TGHLGPFDL

SEQ ID NO: 6064 - protein, 215 aa, Artificial Sequence
  Description of Artificial Sequence: Synthetic polypeptide
  XENP020354 [CTLA-4]_H3.4_L0.131_Fab Light Chain
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 6065 - protein, 108 aa, Artificial Sequence; identical to SEQ ID NO: 2786
  Description of Artificial Sequence: Synthetic polypeptide
  VL of XENP020354

SEQ ID NO: 6066 - protein, 12 aa, Artificial Sequence
  Description of Artificial Sequence: Synthetic peptide
  XENP020354 vlCDR1
RASQSVSSSYLA

SEQ ID NO: 6067 - protein, 7 aa, Artificial Sequence
  Description of Artificial Sequence: Synthetic peptide
  XENP020354 vlCDR2
GASSRAT

SEQ ID NO: 6068 - protein, 9 aa, Artificial Sequence
  Description of Artificial Sequence: Synthetic peptide
  XENP020354 vlCDR3
QQYGSSPWT

SEQ ID NO: 6069 - protein, 221 aa, Artificial Sequence; identical to SEQ ID NO: 5709
  Description of Artificial Sequence: Synthetic polypeptide
  XENP020355 [CTLA-4]_H3.4_L0.132_Fab Heavy Chain

SEQ ID NO: 6070 - protein, 118 aa, Artificial Sequence; identical to SEQ ID NO: 2461
  Description of Artificial Sequence: Synthetic polypeptide
  VH of XENP020355

SEQ ID NO: 6071 - protein, 5 aa, Artificial Sequence
  Description of Artificial Sequence: Synthetic peptide
  XENP020355 vhCDR1
SYTMH

SEQ ID NO: 6072 - protein, 17 aa, Artificial Sequence
  Description of Artificial Sequence: Synthetic peptide
  XENP020355 vhCDR2
FISYDGNHKYYADSVKG

SEQ ID NO: 6073 - protein, 9 aa, Artificial Sequence
  Description of Artificial Sequence: Synthetic peptide
  XENP020355 vhCDR3
TGHLGPFDL

SEQ ID NO: 6074 - protein, 215 aa, Artificial Sequence
  Description of Artificial Sequence: Synthetic polypeptide
  XENP020355 [CTLA-4]_H3.4_L0.132_Fab Light Chain
EIVLTQSPATLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 6075 - protein, 108 aa, Artificial Sequence; identical to SEQ ID NO: 2795
  Description of Artificial Sequence: Synthetic polypeptide
  VL of XENP020355

SEQ ID NO: 6076 - protein, 12 aa, Artificial Sequence
  Description of Artificial Sequence: Synthetic peptide
  XENP020355 vlCDR1
RASQSVSSSYLA

SEQ ID NO: 6077 - protein, 7 aa, Artificial Sequence
  Description of Artificial Sequence: Synthetic peptide
  XENP020355 vlCDR2
GASSRAT

SEQ ID NO: 6078 - protein, 9 aa, Artificial Sequence
  Description of Artificial Sequence: Synthetic peptide
  XENP020355 vlCDR3
QQYGSSPWT

SEQ ID NO: 6079 - protein, 221 aa, Artificial Sequence; identical to SEQ ID NO: 5719
  Description of Artificial Sequence: Synthetic polypeptide
  XENP020356 [CTLA-4]_H3.5_L2_Fab Heavy Chain

SEQ ID NO: 6080 - protein, 118 aa, Artificial Sequence; identical to SEQ ID NO: 2470
  Description of Artificial Sequence: Synthetic polypeptide
  VH of XENP020356

SEQ ID NO: 6081 - protein, 5 aa, Artificial Sequence
  Description of Artificial Sequence: Synthetic peptide
  XENP020356 vhCDR1
SYTMH

SEQ ID NO: 6082 - protein, 17 aa, Artificial Sequence
  Description of Artificial Sequence: Synthetic peptide
  XENP020356 vhCDR2
FISYDGNTKYYADSVKG

SEQ ID NO: 6083 - protein, 9 aa, Artificial Sequence
  Description of Artificial Sequence: Synthetic peptide
  XENP020356 vhCDR3
TGHLGPFDL

SEQ ID NO: 6084 - protein, 215 aa, Artificial Sequence; identical to SEQ ID NO: 5474
  Description of Artificial Sequence: Synthetic polypeptide
  XENP020356 [CTLA-4]_H3.5_L2_Fab Light Chain

SEQ ID NO: 6085 - protein, 108 aa, Artificial Sequence; identical to SEQ ID NO: 167
  Description of Artificial Sequence: Synthetic polypeptide
  VL of XENP020356

SEQ ID NO: 6086 - protein, 12 aa, Artificial Sequence
  Description of Artificial Sequence: Synthetic peptide
  XENP020356 vlCDR1
RASQSVGSSYLA

SEQ ID NO: 6087 - protein, 7 aa, Artificial Sequence
  Description of Artificial Sequence: Synthetic peptide
  XENP020356 vlCDR2
GAFSRAT

SEQ ID NO: 6088 - protein, 9 aa, Artificial Sequence
  Description of Artificial Sequence: Synthetic peptide
  XENP020356 vlCDR3
QQYGSSPWT

SEQ ID NO: 6089 - protein, 221 aa, Artificial Sequence; identical to SEQ ID NO: 5719
  Description of Artificial Sequence: Synthetic polypeptide
  XENP020357 [CTLA-4]_H3.5_L2.1_Fab Heavy Chain

SEQ ID NO: 6090 - protein, 118 aa, Artificial Sequence; identical to SEQ ID NO: 2470
  Description of Artificial Sequence: Synthetic polypeptide
  VH of XENP020357

SEQ ID NO: 6091 - protein, 5 aa, Artificial Sequence
  Description of Artificial Sequence: Synthetic peptide
  XENP020357 vhCDR1
SYTMH

SEQ ID NO: 6092 - protein, 17 aa, Artificial Sequence
  Description of Artificial Sequence: Synthetic peptide
  XENP020357 vhCDR2
FISYDGNTKYYADSVKG

SEQ ID NO: 6093 - protein, 9 aa, Artificial Sequence
  Description of Artificial Sequence: Synthetic peptide
  XENP020357 vhCDR3
TGHLGPFDL

SEQ ID NO: 6094 - protein, 215 aa, Artificial Sequence
  Description of Artificial Sequence: Synthetic polypeptide
  XENP020357 [CTLA-4]_H3.5_L2.1_Fab Light Chain
EIVMTQSPATLSVSPGERATLSCRASQSVSSSYLAWYQQKPGQAPRLLIYGAFSRATGIPARFSGSGSGTEFTLTISSLQSEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 6095 - protein, 108 aa, Artificial Sequence; identical to SEQ ID NO: 2813
  Description of Artificial Sequence: Synthetic polypeptide
  VL of XENP020357

SEQ ID NO: 6096 - protein, 12 aa, Artificial Sequence
  Description of Artificial Sequence: Synthetic peptide
  XENP020357 vlCDR1
RASQSVSSSYLA

SEQ ID NO: 6097 - protein, 7 aa, Artificial Sequence
  Description of Artificial Sequence: Synthetic peptide
  XENP020357 vlCDR2
GAFSRAT

SEQ ID NO: 6098 - protein, 9 aa, Artificial Sequence
  Description of Artificial Sequence: Synthetic peptide
  XENP020357 vlCDR3
QQYGSSPWT

SEQ ID NO: 6099 - protein, 221 aa, Artificial Sequence; identical to SEQ ID NO: 5719
  Description of Artificial Sequence: Synthetic polypeptide
  XENP020358 [CTLA-4]_H3.5_L2.2_Fab Heavy Chain

SEQ ID NO: 6100 - protein, 118 aa, Artificial Sequence; identical to SEQ ID NO: 2470
  Description of Artificial Sequence: Synthetic polypeptide
  VH of XENP020358

SEQ ID NO: 6101 - protein, 5 aa, Artificial Sequence
  Description of Artificial Sequence: Synthetic peptide
  XENP020358 vhCDR1
SYTMH

SEQ ID NO: 6102 - protein, 17 aa, Artificial Sequence
  Description of Artificial Sequence: Synthetic peptide
  XENP020358 vhCDR2
FISYDGNTKYYADSVKG

SEQ ID NO: 6103 - protein, 9 aa, Artificial Sequence
  Description of Artificial Sequence: Synthetic peptide
  XENP020358 vhCDR3
TGHLGPFDL

SEQ ID NO: 6104 - protein, 215 aa, Artificial Sequence
  Description of Artificial Sequence: Synthetic polypeptide
  XENP020358 [CTLA-4]_H3.5_L2.2_Fab Light Chain
EIVMTQSPATLSVSPGERATLSCRASQSVGSSYLAWYQQKPGQAPRLLIYGASSRATGIPARFSGSGSGTEFTLTISSLQSEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 6105 - protein, 108 aa, Artificial Sequence; identical to SEQ ID NO: 2822
  Description of Artificial Sequence: Synthetic polypeptide
  VL of XENP020358

SEQ ID NO: 6106 - protein, 12 aa, Artificial Sequence
  Description of Artificial Sequence: Synthetic peptide
  XENP020358 vlCDR1
RASQSVGSSYLA

SEQ ID NO: 6107 - protein, 7 aa, Artificial Sequence
  Description of Artificial Sequence: Synthetic peptide
  XENP020358 vlCDR2
GASSRAT

SEQ ID NO: 6108 - protein, 9 aa, Artificial Sequence
  Description of Artificial Sequence: Synthetic peptide
  XENP020358 vlCDR3
QQYGSSPWT

SEQ ID NO: 6109 - protein, 221 aa, Artificial Sequence; identical to SEQ ID NO: 5719
  Description of Artificial Sequence: Synthetic polypeptide
  XENP020359 [CTLA-4]_H3.5_L2.3_Fab Heavy Chain

SEQ ID NO: 6110 - protein, 118 aa, Artificial Sequence; identical to SEQ ID NO: 2470
  Description of Artificial Sequence: Synthetic polypeptide
  VH of XENP020359

SEQ ID NO: 6111 - protein, 5 aa, Artificial Sequence
  Description of Artificial Sequence: Synthetic peptide
  XENP020359 vhCDR1
SYTMH

SEQ ID NO: 6112 - protein, 17 aa, Artificial Sequence
  Description of Artificial Sequence: Synthetic peptide
  XENP020359 vhCDR2
FISYDGNTKYYADSVKG

SEQ ID NO: 6113 - protein, 9 aa, Artificial Sequence
  Description of Artificial Sequence: Synthetic peptide
  XENP020359 vhCDR3
TGHLGPFDL

SEQ ID NO: 6114 - protein, 215 aa, Artificial Sequence
  Description of Artificial Sequence: Synthetic polypeptide
  XENP020359 [CTLA-4]_H3.5_L2.3_Fab Light Chain
EIVMTQSPATLSVSPGERATLSCRASQSVSSSYLAWYQQKPGQAPRLLIYGASSRATGIPARFSGSGSGTEFTLTISSLQSEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 6115 - protein, 108 aa, Artificial Sequence; identical to SEQ ID NO: 2831
  Description of Artificial Sequence: Synthetic polypeptide
  VL of XENP020359

SEQ ID NO: 6116 - protein, 12 aa, Artificial Sequence
  Description of Artificial Sequence: Synthetic peptide
  XENP020359 vlCDR1
RASQSVSSSYLA

SEQ ID NO: 6117 - protein, 7 aa, Artificial Sequence
  Description of Artificial Sequence: Synthetic peptide
  XENP020359 vlCDR2
GASSRAT

SEQ ID NO: 6118 - protein, 9 aa, Artificial Sequence
  Description of Artificial Sequence: Synthetic peptide
  XENP020359 vlCDR3
QQYGSSPWT

SEQ ID NO: 6119 - protein, 221 aa, Artificial Sequence; identical to SEQ ID NO: 5869
  Description of Artificial Sequence: Synthetic polypeptide
  XENP020422 [CTLA-4]_H3.21_L0.124_Fab Heavy Chain

SEQ ID NO: 6120 - protein, 118 aa, Artificial Sequence; identical to SEQ ID NO: 2614
  Description of Artificial Sequence: Synthetic polypeptide
  VH of XENP020422

SEQ ID NO: 6121 - protein, 5 aa, Artificial Sequence
  Description of Artificial Sequence: Synthetic peptide
  XENP020422 vhCDR1
SYTMH

SEQ ID NO: 6122 - protein, 17 aa, Artificial Sequence
  Description of Artificial Sequence: Synthetic peptide
  XENP020422 vhCDR2
FISYDGNTKYYADSVKG

SEQ ID NO: 6123 - protein, 9 aa, Artificial Sequence
  Description of Artificial Sequence: Synthetic peptide
  XENP020422 vhCDR3
GGLLGPFDL

SEQ ID NO: 6124 - protein, 215 aa, Artificial Sequence; identical to SEQ ID NO: 5994
  Description of Artificial Sequence: Synthetic polypeptide
  XENP020422 [CTLA-4]_H3.21_L0.124_Fab Light Chain

SEQ ID NO: 6125 - protein, 108 aa, Artificial Sequence; identical to SEQ ID NO: 2723
  Description of Artificial Sequence: Synthetic polypeptide
  VL of XENP020422

SEQ ID NO: 6126 - protein, 12 aa, Artificial Sequence
  Description of Artificial Sequence: Synthetic peptide
  XENP020422 vlCDR1
RASQSVGSSYLA

SEQ ID NO: 6127 - protein, 7 aa, Artificial Sequence
  Description of Artificial Sequence: Synthetic peptide
  XENP020422 vlCDR2
GASSRAT

SEQ ID NO: 6128 - protein, 9 aa, Artificial Sequence
  Description of Artificial Sequence: Synthetic peptide
  XENP020422 vlCDR3
QQYGSSPWT

SEQ ID NO: 6129 - protein, 221 aa, Artificial Sequence; identical to SEQ ID NO: 5869
  Description of Artificial Sequence: Synthetic polypeptide
  XENP020423 [CTLA-4]_H3.21_L0.129_Fab Heavy Chain

SEQ ID NO: 6130 - protein, 118 aa, Artificial Sequence; identical to SEQ ID NO: 2614
  Description of Artificial Sequence: Synthetic polypeptide
  VH of XENP020423

SEQ ID NO: 6131 - protein, 5 aa, Artificial Sequence
  Description of Artificial Sequence: Synthetic peptide
  XENP020423 vhCDR1
SYTMH

SEQ ID NO: 6132 - protein, 17 aa, Artificial Sequence
  Description of Artificial Sequence: Synthetic peptide
  XENP020423 vhCDR2
FISYDGNTKYYADSVKG

SEQ ID NO: 6133 - protein, 9 aa, Artificial Sequence
  Description of Artificial Sequence: Synthetic peptide
  XENP020423 vhCDR3
GGLLGPFDL

SEQ ID NO: 6134 - protein, 215 aa, Artificial Sequence; identical to SEQ ID NO: 6044
  Description of Artificial Sequence: Synthetic polypeptide
  XENP020423 [CTLA-4]_H3.21_L0.129_Fab Light Chain

SEQ ID NO: 6135 - protein, 108 aa, Artificial Sequence; identical to SEQ ID NO: 2768
  Description of Artificial Sequence: Synthetic polypeptide
  VL of XENP020423

SEQ ID NO: 6136 - protein, 12 aa, Artificial Sequence
  Description of Artificial Sequence: Synthetic peptide
  XENP020423 vlCDR1
RASQSVGSSYLA

SEQ ID NO: 6137 - protein, 7 aa, Artificial Sequence
  Description of Artificial Sequence: Synthetic peptide
  XENP020423 vlCDR2
GASSRAT

SEQ ID NO: 6138 - protein, 9 aa, Artificial Sequence
  Description of Artificial Sequence: Synthetic peptide
  XENP020423 vlCDR3
QQYGSSPWT

SEQ ID NO: 6139 - protein, 221 aa, Artificial Sequence; identical to SEQ ID NO: 5869
  Description of Artificial Sequence: Synthetic polypeptide
  XENP020424 [CTLA-4]_H3.21_L0.132_Fab Heavy Chain

SEQ ID NO: 6140 - protein, 118 aa, Artificial Sequence; identical to SEQ ID NO: 2614
  Description of Artificial Sequence: Synthetic polypeptide
  VH of XENP020424

SEQ ID NO: 6141 - protein, 5 aa, Artificial Sequence
  Description of Artificial Sequence: Synthetic peptide
  XENP020424 vhCDR1
SYTMH

SEQ ID NO: 6142 - protein, 17 aa, Artificial Sequence
  Description of Artificial Sequence: Synthetic peptide
  XENP020424 vhCDR2
FISYDGNTKYYADSVKG

SEQ ID NO: 6143 - protein, 9 aa, Artificial Sequence
  Description of Artificial Sequence: Synthetic peptide
  XENP020424 vhCDR3
GGLLGPFDL

SEQ ID NO: 6144 - protein, 215 aa, Artificial Sequence; identical to SEQ ID NO: 6074
  Description of Artificial Sequence: Synthetic polypeptide
  XENP020424 [CTLA-4]_H3.21_L0.132_Fab Light Chain

SEQ ID NO: 6145 - protein, 108 aa, Artificial Sequence; identical to SEQ ID NO: 2795
  Description of Artificial Sequence: Synthetic polypeptide
  VL of XENP020424

SEQ ID NO: 6146 - protein, 12 aa, Artificial Sequence
  Description of Artificial Sequence: Synthetic peptide
  XENP020424 vlCDR1
RASQSVSSSYLA

SEQ ID NO: 6147 - protein, 7 aa, Artificial Sequence
  Description of Artificial Sequence: Synthetic peptide
  XENP020424 vlCDR2
GASSRAT

SEQ ID NO: 6148 - protein, 9 aa, Artificial Sequence
  Description of Artificial Sequence: Synthetic peptide
  XENP020424 vlCDR3
QQYGSSPWT

SEQ ID NO: 6149 - protein, 221 aa, Artificial Sequence; identical to SEQ ID NO: 5889
  Description of Artificial Sequence: Synthetic polypeptide
  XENP020425 [CTLA-4]_H3.23_L0.124_Fab Heavy Chain

SEQ ID NO: 6150 - protein, 118 aa, Artificial Sequence; identical to SEQ ID NO: 2632
  Description of Artificial Sequence: Synthetic polypeptide
  VH of XENP020425

SEQ ID NO: 6151 - protein, 5 aa, Artificial Sequence
  Description of Artificial Sequence: Synthetic peptide
  XENP020425 vhCDR1
SYTMH

SEQ ID NO: 6152 - protein, 17 aa, Artificial Sequence
  Description of Artificial Sequence: Synthetic peptide
  XENP020425 vhCDR2
FISYDGNYKYYADSVKG

SEQ ID NO: 6153 - protein, 9 aa, Artificial Sequence
  Description of Artificial Sequence: Synthetic peptide
  XENP020425 vhCDR3
GGHLGPFDL

SEQ ID NO: 6154 - protein, 215 aa, Artificial Sequence; identical to SEQ ID NO: 5994
  Description of Artificial Sequence: Synthetic polypeptide
  XENP020425 [CTLA-4]_H3.23_L0.124_Fab Light Chain

SEQ ID NO: 6155 - protein, 108 aa, Artificial Sequence; identical to SEQ ID NO: 2723
  Description of Artificial Sequence: Synthetic polypeptide
  VL of XENP020425

SEQ ID NO: 6156 - protein, 12 aa, Artificial Sequence
  Description of Artificial Sequence: Synthetic peptide
  XENP020425 vlCDR1
RASQSVGSSYLA

SEQ ID NO: 6157 - protein, 7 aa, Artificial Sequence
  Description of Artificial Sequence: Synthetic peptide
  XENP020425 vlCDR2
GASSRAT

SEQ ID NO: 6158 - protein, 9 aa, Artificial Sequence
  Description of Artificial Sequence: Synthetic peptide
  XENP020425 vlCDR3
QQYGSSPWT

SEQ ID NO: 6159 - protein, 221 aa, Artificial Sequence; identical to SEQ ID NO: 5889
  Description of Artificial Sequence: Synthetic polypeptide
  XENP020426 [CTLA-4]_H3.23_L0.129_Fab Heavy Chain

SEQ ID NO: 6160 - protein, 118 aa, Artificial Sequence; identical to SEQ ID NO: 2632
  Description of Artificial Sequence: Synthetic polypeptide
  VH of XENP020426

SEQ ID NO: 6161 - protein, 5 aa, Artificial Sequence
  Description of Artificial Sequence: Synthetic peptide
  XENP020426 vhCDR1
SYTMH

SEQ ID NO: 6162 - protein, 17 aa, Artificial Sequence
  Description of Artificial Sequence: Synthetic peptide
  XENP020426 vhCDR2
FISYDGNYKYYADSVKG

SEQ ID NO: 6163 - protein, 9 aa, Artificial Sequence
  Description of Artificial Sequence: Synthetic peptide
  XENP020426 vhCDR3
GGHLGPFDL

SEQ ID NO: 6164 - protein, 215 aa, Artificial Sequence; identical to SEQ ID NO: 6044
  Description of Artificial Sequence: Synthetic polypeptide
  XENP020426 [CTLA-4]_H3.23_L0.129_Fab Light Chain

SEQ ID NO: 6165 - protein, 108 aa, Artificial Sequence; identical to SEQ ID NO: 2768
  Description of Artificial Sequence: Synthetic polypeptide
  VL of XENP020426

SEQ ID NO: 6166 - protein, 12 aa, Artificial Sequence
  Description of Artificial Sequence: Synthetic peptide
  XENP020426 vlCDR1
RASQSVGSSYLA

SEQ ID NO: 6167 - protein, 7 aa, Artificial Sequence
  Description of Artificial Sequence: Synthetic peptide
  XENP020426 vlCDR2
GASSRAT

SEQ ID NO: 6168 - protein, 9 aa, Artificial Sequence
  Description of Artificial Sequence: Synthetic peptide
  XENP020426 vlCDR3
QQYGSSPWT

SEQ ID NO: 6169 - protein, 221 aa, Artificial Sequence; identical to SEQ ID NO: 5889
  Description of Artificial Sequence: Synthetic polypeptide
  XENP020427 [CTLA-4]_H3.23_L0.132_Fab Heavy Chain

SEQ ID NO: 6170 - protein, 118 aa, Artificial Sequence; identical to SEQ ID NO: 2632
  Description of Artificial Sequence: Synthetic polypeptide
  VH of XENP020427

SEQ ID NO: 6171 - protein, 5 aa, Artificial Sequence
  Description of Artificial Sequence: Synthetic peptide
  XENP020427 vhCDR1
SYTMH

SEQ ID NO: 6172 - protein, 17 aa, Artificial Sequence
  Description of Artificial Sequence: Synthetic peptide
  XENP020427 vhCDR2
FISYDGNYKYYADSVKG

SEQ ID NO: 6173 - protein, 9 aa, Artificial Sequence
  Description of Artificial Sequence: Synthetic peptide
  XENP020427 vhCDR3
GGHLGPFDL

SEQ ID NO: 6174 - protein, 215 aa, Artificial Sequence; identical to SEQ ID NO: 6074
  Description of Artificial Sequence: Synthetic polypeptide
  XENP020427 [CTLA-4]_H3.23_L0.132_Fab Light Chain

SEQ ID NO: 6175 - protein, 108 aa, Artificial Sequence; identical to SEQ ID NO: 2795
  Description of Artificial Sequence: Synthetic polypeptide
  VL of XENP020427

SEQ ID NO: 6176 - protein, 12 aa, Artificial Sequence
  Description of Artificial Sequence: Synthetic peptide
  XENP020427 vlCDR1
RASQSVSSSYLA

SEQ ID NO: 6177 - protein, 7 aa, Artificial Sequence
  Description of Artificial Sequence: Synthetic peptide
  XENP020427 vlCDR2
GASSRAT

SEQ ID NO: 6178 - protein, 9 aa, Artificial Sequence
  Description of Artificial Sequence: Synthetic peptide
  XENP020427 vlCDR3
QQYGSSPWT

SEQ ID NO: 6179 - protein, 221 aa, Artificial Sequence; identical to SEQ ID NO: 5909
  Description of Artificial Sequence: Synthetic polypeptide
  XENP020428 [CTLA-4]_H3.25_L0.124_Fab Heavy Chain

SEQ ID NO: 6180 - protein, 118 aa, Artificial Sequence; identical to SEQ ID NO: 2650
  Description of Artificial Sequence: Synthetic polypeptide
  VH of XENP020428

SEQ ID NO: 6181 - protein, 5 aa, Artificial Sequence
  Description of Artificial Sequence: Synthetic peptide
  XENP020428 vhCDR1
SYTMH

SEQ ID NO: 6182 - protein, 17 aa, Artificial Sequence
  Description of Artificial Sequence: Synthetic peptide
  XENP020428 vhCDR2
FISYDGNYKYYADSVKG

SEQ ID NO: 6183 - protein, 9 aa, Artificial Sequence
  Description of Artificial Sequence: Synthetic peptide
  XENP020428 vhCDR3
GGLLGPFDL

SEQ ID NO: 6184 - protein, 215 aa, Artificial Sequence; identical to SEQ ID NO: 5994
  Description of Artificial Sequence: Synthetic polypeptide
  XENP020428 [CTLA-4]_H3.25_L0.124_Fab Light Chain

SEQ ID NO: 6185 - protein, 108 aa, Artificial Sequence; identical to SEQ ID NO: 2723
  Description of Artificial Sequence: Synthetic polypeptide
  VL of XENP020428

SEQ ID NO: 6186 - protein, 12 aa, Artificial Sequence
  Description of Artificial Sequence: Synthetic peptide
  XENP020428 vlCDR1
RASQSVGSSYLA

SEQ ID NO: 6187 - protein, 7 aa, Artificial Sequence
  Description of Artificial Sequence: Synthetic peptide
  XENP020428 vlCDR2
GASSRAT

SEQ ID NO: 6188 - protein, 9 aa, Artificial Sequence
  Description of Artificial Sequence: Synthetic peptide
  XENP020428 vlCDR3
QQYGSSPWT

SEQ ID NO: 6189 - protein, 221 aa, Artificial Sequence; identical to SEQ ID NO: 5909
  Description of Artificial Sequence: Synthetic polypeptide
  XENP020429 [CTLA-4]_H3.25_L0.129_Fab Heavy Chain

SEQ ID NO: 6190 - protein, 118 aa, Artificial Sequence; identical to SEQ ID NO: 2650
  Description of Artificial Sequence: Synthetic polypeptide
  VH of XENP020429

SEQ ID NO: 6191 - protein, 5 aa, Artificial Sequence
  Description of Artificial Sequence: Synthetic peptide
  XENP020429 vhCDR1
SYTMH

SEQ ID NO: 6192 - protein, 17 aa, Artificial Sequence
  Description of Artificial Sequence: Synthetic peptide
  XENP020429 vhCDR2
FISYDGNYKYYADSVKG

SEQ ID NO: 6193 - protein, 9 aa, Artificial Sequence
  Description of Artificial Sequence: Synthetic peptide
  XENP020429 vhCDR3
GGLLGPFDL

SEQ ID NO: 6194 - protein, 215 aa, Artificial Sequence; identical to SEQ ID NO: 6044
  Description of Artificial Sequence: Synthetic polypeptide
  XENP020429 [CTLA-4]_H3.25_L0.129_Fab Light Chain

SEQ ID NO: 6195 - protein, 108 aa, Artificial Sequence; identical to SEQ ID NO: 2768
  Description of Artificial Sequence: Synthetic polypeptide
  VL of XENP020429

SEQ ID NO: 6196 - protein, 12 aa, Artificial Sequence
  Description of Artificial Sequence: Synthetic peptide
  XENP020429 vlCDR1
RASQSVGSSYLA

SEQ ID NO: 6197 - protein, 7 aa, Artificial Sequence
  Description of Artificial Sequence: Synthetic peptide
  XENP020429 vlCDR2
GASSRAT

SEQ ID NO: 6198 - protein, 9 aa, Artificial Sequence
  Description of Artificial Sequence: Synthetic peptide
  XENP020429 vlCDR3
QQYGSSPWT

SEQ ID NO: 6199 - protein, 221 aa, Artificial Sequence; identical to SEQ ID NO: 5909
  Description of Artificial Sequence: Synthetic polypeptide
  XENP020430 [CTLA-4]_H3.25_L0.132_Fab Heavy Chain

SEQ ID NO: 6200 - protein, 118 aa, Artificial Sequence; identical to SEQ ID NO: 2650
  Description of Artificial Sequence: Synthetic polypeptide
  VH of XENP020430

SEQ ID NO: 6201 - protein, 5 aa, Artificial Sequence
  Description of Artificial Sequence: Synthetic peptide
  XENP020430 vhCDR1
SYTMH

SEQ ID NO: 6202 - protein, 17 aa, Artificial Sequence
  Description of Artificial Sequence: Synthetic peptide
  XENP020430 vhCDR2
FISYDGNYKYYADSVKG

SEQ ID NO: 6203 - protein, 9 aa, Artificial Sequence
  Description of Artificial Sequence: Synthetic peptide
  XENP020430 vhCDR3
GGLLGPFDL

SEQ ID NO: 6204 - protein, 215 aa, Artificial Sequence; identical to SEQ ID NO: 6074
  Description of Artificial Sequence: Synthetic polypeptide
  XENP020430 [CTLA-4]_H3.25_L0.132_Fab Light Chain

SEQ ID NO: 6205 - protein, 108 aa, Artificial Sequence; identical to SEQ ID NO: 2795
  Description of Artificial Sequence: Synthetic polypeptide
  VL of XENP020430

SEQ ID NO: 6206 - protein, 12 aa, Artificial Sequence
  Description of Artificial Sequence: Synthetic peptide
  XENP020430 vlCDR1
RASQSVSSSYLA

SEQ ID NO: 6207 - protein, 7 aa, Artificial Sequence
  Description of Artificial Sequence: Synthetic peptide
  XENP020430 vlCDR2
GASSRAT

SEQ ID NO: 6208 - protein, 9 aa, Artificial Sequence
  Description of Artificial Sequence: Synthetic peptide
  XENP020430 vlCDR3
QQYGSSPWT

SEQ ID NO: 6209 - protein, 240 aa, Artificial Sequence
  Description of Artificial Sequence: Synthetic polypeptide
  XENP016402 nivolumab_H0.1_L0_scFv(GKPGS)4
QVQLVESGGGVVQPGRSLRLSCKASGITFSNSGMHWVRQAPGKGLEWVAVIWYDGSKRYYADSVKGRFTISRDNSKNTLFLQMNSLRAEDTAVYYCATNDDYWGQGTLVTVSSGKPGSGKPGSGKPGSGKPGSEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIK

SEQ ID NO: 6210 - protein, 113 aa, Artificial Sequence
  Description of Artificial Sequence: Synthetic polypeptide
  VH of XENP016402
QVQLVESGGGVVQPGRSLRLSCKASGITFSNSGMHWVRQAPGKGLEWVAVIWYDGSKRYYADSVKGRFTISRDNSKNTLFLQMNSLRAEDTAVYYCATNDDYWGQGTLVTVSS

SEQ ID NO: 6211 - protein, 107 aa, Artificial Sequence [sequence omitted]

SEQ ID NO: 6212 - protein, 5 aa, Artificial Sequence
  Description of Artificial Sequence: Synthetic peptide
  XENP016402 vhCDR1
NSGMH

SEQ ID NO: 6213 - protein, 17 aa, Artificial Sequence
  Description of Artificial Sequence: Synthetic peptide
  XENP016402 vhCDR2
VIWYDGSKRYYADSVKG

SEQ ID NO: 6214 - protein, 4 aa, Artificial Sequence
  Description of Artificial Sequence: Synthetic peptide
  XENP016402 vhCDR3
NDDY

SEQ ID NO: 6215 - protein, 11 aa, Artificial Sequence
  Description of Artificial Sequence: Synthetic peptide
  XENP016402 vlCDR1
RASQSVSSYLA

SEQ ID NO: 6216 - protein, 7 aa, Artificial Sequence
  Description of Artificial Sequence: Synthetic peptide
  XENP016402 vlCDR2
DASNRAT

SEQ ID NO: 6217 - protein, 9 aa, Artificial Sequence
  Description of Artificial Sequence: Synthetic peptide
  XENP016402 vlCDR3
QQSSNWPRT

SEQ ID NO: 6218 - protein, 246 aa, Artificial Sequence
  Description of Artificial Sequence: Synthetic polypeptide
  XENP017919 1A2_H1L1_scFv(GKPGS)4
QIQLVQSGAEVKKPGASVKVSCKASGYTFTDYSMHWVRQAPGQGLEWMGWINTETGEPTYADKFQGRVTMTLDTSTSTAYMELSSLRSEDTAVYFCASSPLDYWGQGTLVTVSSGKPGSGKPGSGKPGSGKPGSDLLLTQSPLSLPVTPGEPASISCRSSQSIVHSNGNTYLEWFLQKPGQSPQLLIYKVFNRFSGVPDRFSGSGSGTDFTLKISRVEAEDVGVYYCFQGSHVPFTFGSGTKLEIK

SEQ ID NO: 6219 - protein, 114 aa, Artificial Sequence
  Description of Artificial Sequence: Synthetic polypeptide
  VH of XENP017919
QIQLVQSGAEVKKPGASVKVSCKASGYTFTDYSMHWVRQAPGQGLEWMGWINTETGEPTYADKFQGRVTMTLDTSTSTAYMELSSLRSEDTAVYFCASSPLDYWGQGTLVTVSS

SEQ ID NO: 6220 - protein, 112 aa, Artificial Sequence
  Description of Artificial Sequence: Synthetic polypeptide
  VL of XENP017919
DLLLTQSPLSLPVTPGEPASISCRSSQSIVHSNGNTYLEWFLQKPGQSPQLLIYKVFNRFSGVPDRFSGSGSGTDFTLKISRVEAEDVGVYYCFQGSHVPFTFGSGTKLEIK

SEQ ID NO: 6221 - protein, 5 aa, Artificial Sequence
  Description of Artificial Sequence: Synthetic peptide
  XENP017919 vhCDR1
DYSMH

SEQ ID NO: 6222 - protein, 17 aa, Artificial Sequence
  Description of Artificial Sequence: Synthetic peptide
  XENP017919 vhCDR2
WINTETGEPTYADKFQG

SEQ ID NO: 6223 - protein, 5 aa, Artificial Sequence
  Description of Artificial Sequence: Synthetic peptide
  XENP017919 vhCDR3
SPLDY

SEQ ID NO: 6224 - protein, 16 aa, Artificial Sequence
  Description of Artificial Sequence: Synthetic peptide
  XENP017919 vlCDR1
RSSQSIVHSNGNTYLE

SEQ ID NO: 6225 - protein, 7 aa, Artificial Sequence
  Description of Artificial Sequence: Synthetic peptide
  XENP017919 vlCDR2
KVFNRFS

SEQ ID NO: 6226 - protein, 9 aa, Artificial Sequence
  Description of Artificial Sequence: Synthetic peptide
  XENP017919 vlCDR3
FQGSHVPFT

SEQ ID NO: 6227 - protein, 251 aa, Artificial Sequence
  Description of Artificial Sequence: Synthetic polypeptide
  XENP017920 1C7_H1L1_scFv(GKPGS)4
EVQLLESGGGLVQPGGSLRLSCAASGFAFSSYDMSWVRQAPGKRLEWVSYISSGGGSTYYPDSVKGRFTISRDNSKNTLYLQMNSLRAEDTAVYYCARPLDDYYAPFAYWGQGTLVTVSSGKPGSGKPGSGKPGSGKPGSDIVLTQSPSSLSASVGDRVTITCRASESVDNDGISFMNWFQQKPGKPPKLLIYAASNQGSGVPARFSGSGSGTDFTLTISSLQPEDFATYFCQQSKEVPWTFGGGTKVEIK

SEQ ID NO: 6228 - protein, 120 aa, Artificial Sequence
  Description of Artificial Sequence: Synthetic polypeptide
  VH of XENP017920
EVQLLESGGGLVQPGGSLRLSCAASGFAFSSYDMSWVRQAPGKRLEWVSYISSGGGSTYYPDSVKGRFTISRDNSKNTLYLQMNSLRAEDTAVYYCARPLDDYYAPFAYWGQGTLVTVSS

SEQ ID NO: 6229 - protein, 111 aa, Artificial Sequence
  Description of Artificial Sequence: Synthetic polypeptide
  VL of XENP017920
DIVLTQSPSSLSASVGDRVTITCRASESVDNDGISFMNWFQQKPGKPPKLLIYAASNQGSGVPARFSGSGSGTDFTLTISSLQPEDFATYFCQQSKEVPWTFGGGTKVEIK

SEQ ID NO: 6230 - protein, 5 aa, Artificial Sequence
  Description of Artificial Sequence: Synthetic peptide
  XENP017920 vhCDR1
SYDMS

SEQ ID NO: 6231 - protein, 17 aa, Artificial Sequence
  Description of Artificial Sequence: Synthetic peptide
  XENP017920 vhCDR2
YISSGGGSTYYPDSVKG

SEQ ID NO: 6232 - protein, 11 aa, Artificial Sequence
  Description of Artificial Sequence: Synthetic peptide
  XENP017920 vhCDR3
PLDDYYAPFAY

SEQ ID NO: 6233 - protein, 15 aa, Artificial Sequence
  Description of Artificial Sequence: Synthetic peptide
  XENP017920 vlCDR1
RASESVDNDGISFMN

SEQ ID NO: 6234 - protein, 7 aa, Artificial Sequence
  Description of Artificial Sequence: Synthetic peptide
  XENP017920 vlCDR2
AASNQGS

SEQ ID NO: 6235 - protein, 9 aa, Artificial Sequence
  Description of Artificial Sequence: Synthetic peptide
  XENP017920 vlCDR3
QQSKEVPWT

SEQ ID NO: 6236 - protein, 246 aa, Artificial Sequence
  Description of Artificial Sequence: Synthetic polypeptide
  XENP017921 1G2_H1L1_scFv(GKPGS)4
QVQLVQSGAEVKKPGASVKVSCKVSGFSLTDYGVNWVRQAPGQGLEWMGMIWGDGSTDYNSKFQGRVTMTKDISTSTVYMELSSLRSEDTAVYYCAREYAMDYWGQGTLVTVSSGKPGSGKPGSGKPGSGKPGSDIVMTQSPDSLAVSLGERATINCKSSQSLLNSRTRKNYLAWYQQKPGQSPKLLIFWASTRESGVPDRFTGSGSGTDFTLTISSLQAEDVAVYYCKQSYNLRTFGGGTKVEIK

SEQ ID NO: 6237 - protein, 114 aa, Artificial Sequence
  Description of Artificial Sequence: Synthetic polypeptide
  VH of XENP017921
QVQLVQSGAEVKKPGASVKVSCKVSGFSLTDYGVNWVRQAPGQGLEWMGMIWGDGSTDYNSKFQGRVTMTKDISTSTVYMELSSLRSEDTAVYYCAREYAMDYWGQGTLVTVSS

SEQ ID NO: 6238 - protein, 112 aa, Artificial Sequence
  Description of Artificial Sequence: Synthetic polypeptide
  VL of XENP017921
DIVMTQSPDSLAVSLGERATINCKSSQSLLNSRTRKNYLAWYQQKPGQSPKLLIFWASTRESGVPDRFTGSGSGTDFTLTISSLQAEDVAVYYCKQSYNLRTFGGGTKVEIK

SEQ ID NO: 6239 - protein, 5 aa, Artificial Sequence
  Description of Artificial Sequence: Synthetic peptide
  XENP017921 vhCDR1
DYGVN

SEQ ID NO: 6240 - protein, 16 aa, Artificial Sequence
  Description of Artificial Sequence: Synthetic peptide
  XENP017921 vhCDR2
MIWGDGSTDYNSKFQG

SEQ ID NO: 6241 - protein, 6 aa, Artificial Sequence
  Description of Artificial Sequence: Synthetic peptide
  XENP017921 vhCDR3
EYAMDY

SEQ ID NO: 6242 - protein, 17 aa, Artificial Sequence
  Description of Artificial Sequence: Synthetic peptide
  XENP017921 vlCDR1
KSSQSLLNSRTRKNYLA

SEQ ID NO: 6243 - protein, 7 aa, Artificial Sequence
  Description of Artificial Sequence: Synthetic peptide
  XENP017921 vlCDR2
WASTRES

SEQ ID NO: 6244 - protein, 8 aa, Artificial Sequence
  Description of Artificial Sequence: Synthetic peptide
  XENP017921 vlCDR3
KQSYNLRT

SEQ ID NO: 6245 - protein, 249 aa, Artificial Sequence
  Description of Artificial Sequence: Synthetic polypeptide
  XENP017922 1G6_H1L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6246 - protein, 122 aa, Artificial Sequence
  Description of Artificial Sequence: Synthetic polypeptide
  VH of XENP017922
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6247 - protein, 107 aa, Artificial Sequence
  Description of Artificial Sequence: Synthetic polypeptide
  VL of XENP017922
SIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6248 - protein, 5 aa, Artificial Sequence
  Description of Artificial Sequence: Synthetic peptide
  XENP017922 vhCDR1
NYWMN

SEQ ID NO: 6249 - protein, 19 aa, Artificial Sequence
  Description of Artificial Sequence: Synthetic peptide
  XENP017922 vhCDR2
EIRLKSNNYATHYAEPVKG

SEQ ID NO: 6250 - protein, 11 aa, Artificial Sequence
  Description of Artificial Sequence: Synthetic peptide
  XENP017922 vhCDR3
YYGNYGGYFDV

SEQ ID NO: 6251 - protein, 11 aa, Artificial Sequence
  Description of Artificial Sequence: Synthetic peptide
  XENP017922 vlCDR1
RASQSVSNDVA

SEQ ID NO: 6252 - protein, 7 aa, Artificial Sequence
  Description of Artificial Sequence: Synthetic peptide
  XENP017922 vlCDR2
YASHRYT

SEQ ID NO: 6253 - protein, 9 aa, Artificial Sequence
  Description of Artificial Sequence: Synthetic peptide
  XENP017922 vlCDR3
QQDYSSPRT

SEQ ID NO: 6254 - protein, 249 aa, Artificial Sequence
  Description of Artificial Sequence: Synthetic polypeptide
  XENP017923 1G6_H1L2_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPSSLSASVGDRVTITCRASQSVSNDVAWYQQKPGKSPKLLINYASHRYTGVPDRFTGSGYGTDFTLTISSLQPEDFATYFCQQDYSSPRTFGGGTKVEIK

SEQ ID NO: 6255 - protein, 122 aa, Artificial Sequence; identical to SEQ ID NO: 6246
  Description of Artificial Sequence: Synthetic polypeptide
  VH of XENP017923

SEQ ID NO: 6256 - protein, 107 aa, Artificial Sequence
  Description of Artificial Sequence: Synthetic polypeptide
  VL of XENP017923
SIVMTQSPSSLSASVGDRVTITCRASQSVSNDVAWYQQKPGKSPKLLINYASHRYTGVPDRFTGSGYGTDFTLTISSLQPEDFATYFCQQDYSSPRTFGGGTKVEIK

SEQ ID NO: 6257 - protein, 5 aa, Artificial Sequence
  Description of Artificial Sequence: Synthetic peptide
  XENP017923 vhCDR1
NYWMN

SEQ ID NO: 6258 - protein, 19 aa, Artificial Sequence
  Description of Artificial Sequence: Synthetic peptide
  XENP017923 vhCDR2
EIRLKSNNYATHYAEPVKG

SEQ ID NO: 6259 - protein, 11 aa, Artificial Sequence
  Description of Artificial Sequence: Synthetic peptide
  XENP017923 vhCDR3
YYGNYGGYFDV

SEQ ID NO: 6260 - protein, 11 aa, Artificial Sequence
  Description of Artificial Sequence: Synthetic peptide
  XENP017923 vlCDR1
RASQSVSNDVA

SEQ ID NO: 6261 - protein, 7 aa, Artificial Sequence
  Description of Artificial Sequence: Synthetic peptide
  XENP017923 vlCDR2
YASHRYT

SEQ ID NO: 6262 - protein, 9 aa, Artificial Sequence
  Description of Artificial Sequence: Synthetic peptide
  XENP017923 vlCDR3
QQDYSSPRT

SEQ ID NO: 6263 - protein, 242 aa, Artificial Sequence
  Description of Artificial Sequence: Synthetic polypeptide
  XENP017924 2A2_H1L1_scFv(GKPGS)4
QVQLVQSGAEVKKPGASVKVSCKASGYTFTNYWMHWVRQAPGQGLEWMGYINPSTGYTEYNQKFQGRVTMTADKSTSTAYMELSSLRSEDTAVYYCATGNYFAYWGQGTLVTVSSGKPGSGKPGSGKPGSGKPGSDIQMTQSPSSLSASVGDRVTITCRPSESLYSYLAWYQQKPGKSPKLLVYNAKTLVEGVPSRFSGSGSGTDFTLTISSLQPEDFATYYCQHHYGTPFTFGSGTKLEIK

SEQ ID NO: 6264 - protein, 115 aa, Artificial Sequence
  Description of Artificial Sequence: Synthetic polypeptide
  VH of XENP017924
QVQLVQSGAEVKKPGASVKVSCKASGYTFTNYWMHWVRQAPGQGLEWMGYINPSTGYTEYNQKFQGRVTMTADKSTSTAYMELSSLRSEDTAVYYCATGNYFAYWGQGTLVTVSS

SEQ ID NO: 6265 - protein, 107 aa, Artificial Sequence
  Description of Artificial Sequence: Synthetic polypeptide
  VL of XENP017924
DIQMTQSPSSLSASVGDRVTITCRPSESLYSYLAWYQQKPGKSPKLLVYNAKTLVEGVPSRFSGSGSGTDFTLTISSLQPEDFATYYCQHHYGTPFTFGSGTKLEIK

SEQ ID NO: 6266 - protein, 5 aa, Artificial Sequence
  Description of Artificial Sequence: Synthetic peptide
  XENP017924 vhCDR1
NYWMH

SEQ ID NO: 6267 - protein, 17 aa, Artificial Sequence
  Description of Artificial Sequence: Synthetic peptide
  XENP017924 vhCDR2
YINPSTGYTEYNQKFQG

SEQ ID NO: 6268 - protein, 6 aa, Artificial Sequence
  Description of Artificial Sequence: Synthetic peptide
  XENP017924 vhCDR3
GNYFAY

SEQ ID NO: 6269 - protein, 11 aa, Artificial Sequence
  Description of Artificial Sequence: Synthetic peptide
  XENP017924 vlCDR1
RPSESLYSYLA

SEQ ID NO: 6270 - protein, 7 aa, Artificial Sequence
  Description of Artificial Sequence: Synthetic peptide
  XENP017924 vlCDR2
NAKTLVE

SEQ ID NO: 6271 - protein, 9 aa, Artificial Sequence
  Description of Artificial Sequence: Synthetic peptide
  XENP017924 vlCDR3
QHHYGTPFT

SEQ ID NO: 6272 - protein, 252 aa, Artificial Sequence
  Description of Artificial Sequence: Synthetic polypeptide
  XENP017925 2F11_H1L1_scFv(GKPGS)4
QVQLVQSGAEVKKPGASVKVSCKGSGYTFTDYVMHWVRQAPGQSLEWMGVISTYYGDASYNQKFQGRVTMTVDKSTSTAYMELSSLRSEDTAVYYCAREGYDGYLYFDVWGAGTLVTVSSGKPGSGKPGSGKPGSGKPGSDVLMTQTPLSSPVTLGQPASISCRSSQSIVHSNGNTYLEWYQQRPGQSPRLLIYKVSNRFSGVPDRFSGSGSGTDFTLKISRVEAEDVGVYYCFQGSHVPYTFGGGTKVEIK

SEQ ID NO: 6273 - protein, 120 aa, Artificial Sequence
  Description of Artificial Sequence: Synthetic polypeptide
  VH of XENP017925
QVQLVQSGAEVKKPGASVKVSCKGSGYTFTDYVMHWVRQAPGQSLEWMGVISTYYGDASYNQKFQGRVTMTVDKSTSTAYMELSSLRSEDTAVYYCAREGYDGYLYFDVWGAGTLVTVSS

SEQ ID NO: 6274 - protein, 112 aa, Artificial Sequence
  Description of Artificial Sequence: Synthetic polypeptide
  VL of XENP017925
DVLMTQTPLSSPVTLGQPASISCRSSQSIVHSNGNTYLEWYQQRPGQSPRLLIYKVSNRFSGVPDRFSGSGSGTDFTLKISRVEAEDVGVYYCFQGSHVPYTFGGGTKVEIK

SEQ ID NO: 6275 - protein, 5 aa, Artificial Sequence
  Description of Artificial Sequence: Synthetic peptide
  XENP017925 vhCDR1
DYVMH

SEQ ID NO: 6276 - protein, 17 aa, Artificial Sequence
  Description of Artificial Sequence: Synthetic peptide
  XENP017925 vhCDR2
VISTYYGDASYNQKFQG

SEQ ID NO: 6277 - protein, 11 aa, Artificial Sequence
  Description of Artificial Sequence: Synthetic peptide
  XENP017925 vhCDR3
EGYDGYLYFDV

SEQ ID NO: 6278 - protein, 16 aa, Artificial Sequence
  Description of Artificial Sequence: Synthetic peptide
  XENP017925 vlCDR1
RSSQSIVHSNGNTYLE

SEQ ID NO: 6279 - protein, 7 aa, Artificial Sequence
  Description of Artificial Sequence: Synthetic peptide
  XENP017925 vlCDR2
KVSNRFS

SEQ ID NO: 6280 - protein, 9 aa, Artificial Sequence
  Description of Artificial Sequence: Synthetic peptide
  XENP017925 vlCDR3
FQGSHVPYT

SEQ ID NO: 6281 - protein, 252 aa, Artificial Sequence
  Description of Artificial Sequence: Synthetic polypeptide
  XENP017926 5H1_H1L1_scFv(GKPGS)4
QVQLVQSGAEVKKPGASVKVSCKGSGYTFTDYVMHWVRQAPGQSLEWMGVISIHYGDGRYNQKFQGRVTMTVDKSTSTAYMELSSLRSEDTAVYYCAREVYDGYLYFDVWGAGTLVTVSSGKPGSGKPGSGKPGSGKPGSDVLMTQSPLSLPVTPGEPASISCRSSQSIVHSNGNTYLEWYLQKPGQSPQLLIYKVSNRFSGVPDRFGGRGSGTDFTLKISRVEAEDVGVYYCFQGSHVPYTFGGGTKVEIK

SEQ ID NO: 6282 - protein, 120 aa, Artificial Sequence
  Description of Artificial Sequence: Synthetic polypeptide
  VH of XENP017926
QVQLVQSGAEVKKPGASVKVSCKGSGYTFTDYVMHWVRQAPGQSLEWMGVISIHYGDGRYNQKFQGRVTMTVDKSTSTAYMELSSLRSEDTAVYYCAREVYDGYLYFDVWGAGTLVTVSS

SEQ ID NO: 6283 - protein, 112 aa, Artificial Sequence
  Description of Artificial Sequence: Synthetic polypeptide
  VL of XENP017926
DVLMTQSPLSLPVTPGEPASISCRSSQSIVHSNGNTYLEWYLQKPGQSPQLLIYKVSNRFSGVPDRFGGRGSGTDFTLKISRVEAEDVGVYYCFQGSHVPYTFGGGTKVEIK

SEQ ID NO: 6284 - protein, 5 aa, Artificial Sequence
  Description of Artificial Sequence: Synthetic peptide
  XENP017926 vhCDR1
DYVMH

SEQ ID NO: 6285 - protein, 17 aa, Artificial Sequence
  Description of Artificial Sequence: Synthetic peptide
  XENP017926 vhCDR2
VISIHYGDGRYNQKFQG

SEQ ID NO: 6286 - protein, 11 aa, Artificial Sequence
  Description of Artificial Sequence: Synthetic peptide
  XENP017926 vhCDR3
EVYDGYLYFDV

SEQ ID NO: 6287 - protein, 16 aa, Artificial Sequence
  Description of Artificial Sequence: Synthetic peptide
  XENP017926 vlCDR1
RSSQSIVHSNGNTYLE

SEQ ID NO: 6288 - protein, 7 aa, Artificial Sequence
  Description of Artificial Sequence: Synthetic peptide
  XENP017926 vlCDR2
KVSNRFS

SEQ ID NO: 6289 - protein, 9 aa, Artificial Sequence
  Description of Artificial Sequence: Synthetic peptide
  XENP017926 vlCDR3
FQGSHVPYT

SEQ ID NO: 6290 - protein, 252 aa, Artificial Sequence
  Description of Artificial Sequence: Synthetic polypeptide
  XENP017927 5H1_H1L2_scFv(GKPGS)4
QVQLVQSGAEVKKPGASVKVSCKGSGYTFTDYVMHWVRQAPGQSLEWMGVISIHYGDGRYNQKFQGRVTMTVDKSTSTAYMELSSLRSEDTAVYYCAREVYDGYLYFDVWGAGTLVTVSSGKPGSGKPGSGKPGSGKPGSDVLMTQSPLSLPVTLGQPASISCRSSQSIVHSNGNTYLEWYQQRPGQSPRLLIYKVSNRFSGVPDRFGGRGSGTDFTLKISRVEAEDVGVYYCFQGSHVPYTFGGGTKVEIK

SEQ ID NO: 6291 - protein, 120 aa, Artificial Sequence; identical to SEQ ID NO: 6282
  Description of Artificial Sequence: Synthetic polypeptide
  VH of XENP017927

SEQ ID NO: 6292 - protein, 112 aa, Artificial Sequence
  Description of Artificial Sequence: Synthetic polypeptide
  VL of XENP017927
DVLMTQSPLSLPVTLGQPASISCRSSQSIVHSNGNTYLEWYQQRPGQSPRLLIYKVSNRFSGVPDRFGGRGSGTDFTLKISRVEAEDVGVYYCFQGSHVPYTFGGGTKVEIK

SEQ ID NO: 6293 - protein, 5 aa, Artificial Sequence
  Description of Artificial Sequence: Synthetic peptide
  XENP017927 vhCDR1
DYVMH

SEQ ID NO: 6294 - protein, 17 aa, Artificial Sequence
  Description of Artificial Sequence: Synthetic peptide
  XENP017927 vhCDR2
VISIHYGDGRYNQKFQG

SEQ ID NO: 6295 - protein, 11 aa, Artificial Sequence
  Description of Artificial Sequence: Synthetic peptide
  XENP017927 vhCDR3
EVYDGYLYFDV

SEQ ID NO: 6296 - protein, 16 aa, Artificial Sequence
  Description of Artificial Sequence: Synthetic peptide
  XENP017927 vlCDR1
RSSQSIVHSNGNTYLE

SEQ ID NO: 6297 - protein, 7 aa, Artificial Sequence
  Description of Artificial Sequence: Synthetic peptide
  XENP017927 vlCDR2
KVSNRFS

SEQ ID NO: 6298 - protein, 9 aa, Artificial Sequence
  Description of Artificial Sequence: Synthetic peptide
  XENP017927 vlCDR3
FQGSHVPYT

SEQ ID NO: 6299 - protein, 247 aa, Artificial Sequence
  Description of Artificial Sequence: Synthetic polypeptide
  XENP017928 10E4_H1L1_scFv(GKPGS)4
QVQLVQSGAEVKKPGASVKVSCKASGYSFTSYWMHWVRQAPGQGLEWMGAIYPGNSDTSYNQKFQGRVTMTADTSTSTAYMELSSLRSEDTAVYYCTRDGNYVRYYFDYWGQGTLVTVSSGKPGSGKPGSGKPGSGKPGSDIQMTQSPSSLSASVGDRVTITCRASQDIGSNLNWLQQKPGKTIKRLIYATSNLDSGVPKRFSGRRSGSDYTLTISSLQPEDFATYYCLQYASSPLTFGTGTKLEIK

SEQ ID NO: 6300 - protein, 120 aa, Artificial Sequence
  Description of Artificial Sequence: Synthetic polypeptide
  VH of XENP017928
QVQLVQSGAEVKKPGASVKVSCKASGYSFTSYWMHWVRQAPGQGLEWMGAIYPGNSDTSYNQKFQGRVTMTADTSTSTAYMELSSLRSEDTAVYYCTRDGNYVRYYFDYWGQGTLVTVSS

SEQ ID NO: 6301 - protein, 107 aa, Artificial Sequence
  Description of Artificial Sequence: Synthetic polypeptide
  VL of XENP017928
DIQMTQSPSSLSASVGDRVTITCRASQDIGSNLNWLQQKPGKTIKRLIYATSNLDSGVPKRFSGRRSGSDYTLTISSLQPEDFATYYCLQYASSPLTFGTGTKLEIK

SEQ ID NO: 6302 - protein, 5 aa, Artificial Sequence
  Description of Artificial Sequence: Synthetic peptide
  XENP017928 vhCDR1
SYWMH

SEQ ID NO: 6303 - protein, 17 aa, Artificial Sequence
  Description of Artificial Sequence: Synthetic peptide
  XENP017928 vhCDR2
AIYPGNSDTSYNQKFQG

SEQ ID NO: 6304 - protein, 11 aa, Artificial Sequence
  Description of Artificial Sequence: Synthetic peptide
  XENP017928 vhCDR3
DGNYVRYYFDY

SEQ ID NO: 6305 - protein, 11 aa, Artificial Sequence
  Description of Artificial Sequence: Synthetic peptide
  XENP017928 vlCDR1
RASQDIGSNLN

SEQ ID NO: 6306 - protein, 7 aa, Artificial Sequence
  Description of Artificial Sequence: Synthetic peptide
  XENP017928 vlCDR2
ATSNLDS

SEQ ID NO: 6307 - protein, 9 aa, Artificial Sequence
  Description of Artificial Sequence: Synthetic peptide
  XENP017928 vlCDR3
LQYASSPLT

SEQ ID NO: 6308 - protein, 247 aa, Artificial Sequence
  Description of Artificial Sequence: Synthetic polypeptide
  XENP017929 4C11_H1L1_scFv(GKPGS)4
QIQLVQSGAEVKKPGASVKVSCKASGYTFTSYWMHWVRQAPGQGLEWMGAIYPGNSDTSYNQKFQGRVTMTADTSTSTAYMELSSLRSEDTAVYYCTNLYYGSSFAMDYWGQGTLVTVSSGKPGSGKPGSGKPGSGKPGSDIKMTQSPSSLSASVGDRVTITCRASQDINTYLSWFQQKPGKSPKTLIYRANRLVDGVPSRFSGSGSGQDYTLTISSLQPEDFATYYCLHYDDFPYTFGGGTKVEIK

SEQ ID NO: 6309 - protein, 120 aa, Artificial Sequence
  Description of Artificial Sequence: Synthetic polypeptide
  VH of XENP017929
QIQLVQSGAEVKKPGASVKVSCKASGYTFTSYWMHWVRQAPGQGLEWMGAIYPGNSDTSYNQKFQGRVTMTADTSTSTAYMELSSLRSEDTAVYYCTNLYYGSSFAMDYWGQGTLVTVSS

SEQ ID NO: 6310 - protein, 107 aa, Artificial Sequence
  Description of Artificial Sequence: Synthetic polypeptide
  VL of XENP017929
DIKMTQSPSSLSASVGDRVTITCRASQDINTYLSWFQQKPGKSPKTLIYRANRLVDGVPSRFSGSGSGQDYTLTISSLQPEDFATYYCLHYDDFPYTFGGGTKVEIK

SEQ ID NO: 6311 - protein, 5 aa, Artificial Sequence
  Description of Artificial Sequence: Synthetic peptide
  XENP017929 vhCDR1
SYWMH

SEQ ID NO: 6312 - protein, 17 aa, Artificial Sequence
  Description of Artificial Sequence: Synthetic peptide
  XENP017929 vhCDR2
AIYPGNSDTSYNQKFQG

SEQ ID NO: 6313 - protein, 11 aa, Artificial Sequence
  Description of Artificial Sequence: Synthetic peptide
  XENP017929 vhCDR3
LYYGSSFAMDY

SEQ ID NO: 6314 - protein, 11 aa, Artificial Sequence
  Description of Artificial Sequence: Synthetic peptide
  XENP017929 vlCDR1
RASQDINTYLS

SEQ ID NO: 6315 - protein, 7 aa, Artificial Sequence
  Description of Artificial Sequence: Synthetic peptide
  XENP017929 vlCDR2
RANRLVD

SEQ ID NO: 6316 - protein, 9 aa, Artificial Sequence
  Description of Artificial Sequence: Synthetic peptide
  XENP017929 vlCDR3
LHYDDFPYT

SEQ ID NO: 6317 - protein, 244 aa, Artificial Sequence
  Description of Artificial Sequence: Synthetic polypeptide
  XENP017930 6A3_H1L1_scFv(GKPGS)4
EVQLLESGGGLVQPGGSLRLSCAASGFTFSSYGMSWVRQAPGKRLEWVSTISGGGRYTYYPDSVKGRFTISRDNSKNTLYLQMNSLRAEDTAVYYCASYYDSSFDYWGQGTLVTVSSGKPGSGKPGSGKPGSGKPGSDIVMTQSPDSLAVSLGERATINCKASQDVGTAVAWYQQKPGQSPKLLIYWASTRHTGVPDRFTGSGSGTDFTLTISSLQAEDVAVYFCQHYSIYPWTFGGGTKVEIK

SEQ ID NO: 6318 - protein, 117 aa, Artificial Sequence
  Description of Artificial Sequence: Synthetic polypeptide
  VH of XENP017930
EVQLLESGGGLVQPGGSLRLSCAASGFTFSSYGMSWVRQAPGKRLEWVSTISGGGRYTYYPDSVKGRFTISRDNSKNTLYLQMNSLRAEDTAVYYCASYYDSSFDYWGQGTLVTVSS

SEQ ID NO: 6319 - protein, 107 aa, Artificial Sequence
  Description of Artificial Sequence: Synthetic polypeptide
  VL of XENP017930
DIVMTQSPDSLAVSLGERATINCKASQDVGTAVAWYQQKPGQSPKLLIYWASTRHTGVPDRFTGSGSGTDFTLTISSLQAEDVAVYFCQHYSIYPWTFGGGTKVEIK

SEQ ID NO: 6320 - protein, 5 aa, Artificial Sequence
  Description of Artificial Sequence: Synthetic peptide
  XENP017930 vhCDR1
SYGMS

SEQ ID NO: 6321 - protein, 17 aa, Artificial Sequence
  Description of Artificial Sequence: Synthetic peptide
  XENP017930 vhCDR2
TISGGGRYTYYPDSVKG

SEQ ID NO: 6322 - protein, 8 aa, Artificial Sequence
  Description of Artificial Sequence: Synthetic peptide
  XENP017930 vhCDR3
YYDSSFDY

SEQ ID NO: 6323 - protein, 11 aa, Artificial Sequence
  Description of Artificial Sequence: Synthetic peptide
  XENP017930 vlCDR1
KASQDVGTAVA

SEQ ID NO: 6324 - protein, 7 aa, Artificial Sequence
  Description of Artificial Sequence: Synthetic peptide
  XENP017930 vlCDR2
WASTRHT

SEQ ID NO: 6325 - protein, 9 aa, Artificial Sequence
  Description of Artificial Sequence: Synthetic peptide
  XENP017930 vlCDR3
QHYSIYPWT

SEQ ID NO: 6326 - protein, 244 aa, Artificial Sequence
  Description of Artificial Sequence: Synthetic polypeptide
  XENP017931 6A3_H1L2_scFv(GKPGS)4
EVQLLESGGGLVQPGGSLRLSCAASGFTFSSYGMSWVRQAPGKRLEWVSTISGGGRYTYYPDSVKGRFTISRDNSKNTLYLQMNSLRAEDTAVYYCASYYDSSFDYWGQGTLVTVSSGKPGSGKPGSGKPGSGKPGSDIVMTQSPATLSVSPGERATLSCRASQDVGTAVAWYQQKPGQSPRLLIYWASTRHTGVPDRFTGSGSGTEFTLTISSLQSEDFAVYFCQHYSIYPWTFGGGTKVEIK

SEQ ID NO: 6327 - protein, 117 aa, Artificial Sequence; identical to SEQ ID NO: 6318
  Description of Artificial Sequence: Synthetic polypeptide
  VH of XENP017931

SEQ ID NO: 6328 - protein, 107 aa, Artificial Sequence
  Description of Artificial Sequence: Synthetic polypeptide
  VL of XENP017931
DIVMTQSPATLSVSPGERATLSCRASQDVGTAVAWYQQKPGQSPRLLIYWASTRHTGVPDRFTGSGSGTEFTLTISSLQSEDFAVYFCQHYSIYPWTFGGGTKVEIK

SEQ ID NO: 6329 - protein, 5 aa, Artificial Sequence
  Description of Artificial Sequence: Synthetic peptide
  XENP017931 vhCDR1
SYGMS

SEQ ID NO: 6330 - protein, 17 aa, Artificial Sequence
  Description of Artificial Sequence: Synthetic peptide
  XENP017931 vhCDR2
TISGGGRYTYYPDSVKG

SEQ ID NO: 6331 - protein, 8 aa, Artificial Sequence
  Description of Artificial Sequence: Synthetic peptide
  XENP017931 vhCDR3
YYDSSFDY

SEQ ID NO: 6332 - protein, 11 aa, Artificial Sequence
  Description of Artificial Sequence: Synthetic peptide
  XENP017931 vlCDR1
RASQDVGTAVA

SEQ ID NO: 6333 - protein, 7 aa, Artificial Sequence
  Description of Artificial Sequence: Synthetic peptide
  XENP017931 vlCDR2
WASTRHT

SEQ ID NO: 6334 - protein, 9 aa, Artificial Sequence
  Description of Artificial Sequence: Synthetic peptide
  XENP017931 vlCDR3
QHYSIYPWT

SEQ ID NO: 6335 - protein, 244 aa, Artificial Sequence
  Description of Artificial Sequence: Synthetic polypeptide
  XENP017932 6A3_H1L3_scFv(GKPGS)4
EVQLLESGGGLVQPGGSLRLSCAASGFTFSSYGMSWVRQAPGKRLEWVSTISGGGRYTYYPDSVKGRFTISRDNSKNTLYLQMNSLRAEDTAVYYCASYYDSSFDYWGQGTLVTVSSGKPGSGKPGSGKPGSGKPGSDIVMTQSPSSLSASVGDRVTITCRASQDVGTAVAWYQQKPGKSPKLLIYWASTRHTGVPDRFTGSGSGTDFTLTISSLQPEDFATYFCQHYSIYPWTFGGGTKVEIK

SEQ ID NO: 6336 - protein, 117 aa, Artificial Sequence; identical to SEQ ID NO: 6318
  Description of Artificial Sequence: Synthetic polypeptide
  VH of XENP017932

SEQ ID NO: 6337 - protein, 107 aa, Artificial Sequence
  Description of Artificial Sequence: Synthetic polypeptide
  VL of XENP017932
DIVMTQSPSSLSASVGDRVTITCRASQDVGTAVAWYQQKPGKSPKLLIYWASTRHTGVPDRFTGSGSGTDFTLTISSLQPEDFATYFCQHYSIYPWTFGGGTKVEIK

SEQ ID NO: 6338 - protein, 5 aa, Artificial Sequence
  Description of Artificial Sequence: Synthetic peptide
  XENP017932 vhCDR1
SYGMS

SEQ ID NO: 6339 - protein, 17 aa, Artificial Sequence
  Description of Artificial Sequence: Synthetic peptide
  XENP017932 vhCDR2
TISGGGRYTYYPDSVKG

SEQ ID NO: 6340 - protein, 8 aa, Artificial Sequence
  Description of Artificial Sequence: Synthetic peptide
  XENP017932 vhCDR3
YYDSSFDY

SEQ ID NO: 6341 - protein, 11 aa, Artificial Sequence
  Description of Artificial Sequence: Synthetic peptide
  XENP017932 vlCDR1
RASQDVGTAVA

SEQ ID NO: 6342 - protein, 7 aa, Artificial Sequence
  Description of Artificial Sequence: Synthetic peptide
  XENP017932 vlCDR2
WASTRHT

SEQ ID NO: 6343 - protein, 9 aa, Artificial Sequence
  Description of Artificial Sequence: Synthetic peptide
  XENP017932 vlCDR3
QHYSIYPWT

SEQ ID NO: 6344 - protein, 244 aa, Artificial Sequence
  Description of Artificial Sequence: Synthetic polypeptide
  XENP017933 6A3_H2L3_scFv(GKPGS)4
QVQLVESGGGLVKPGGSLRLSCAASGFTFSSYGMSWVRQAPGKRLEWVSTISGGGRYTYYPDSVKGRFTISRDNAKNSLYLQMNSLRAEDTAVYYCASYYDSSFDYWGQGTLVTVSSGKPGSGKPGSGKPGSGKPGSDIVMTQSPSSLSASVGDRVTITCRASQDVGTAVAWYQQKPGKSPKLLIYWASTRHTGVPDRFTGSGSGTDFTLTISSLQPEDFATYFCQHYSIYPWTFGGGTKVEIK

SEQ ID NO: 6345 - protein, 117 aa, Artificial Sequence
  Description of Artificial Sequence: Synthetic polypeptide
  VH of XENP017933
QVQLVESGGGLVKPGGSLRLSCAASGFTFSSYGMSWVRQAPGKRLEWVSTISGGGRYTYYPDSVKGRFTISRDNAKNSLYLQMNSLRAEDTAVYYCASYYDSSFDYWGQGTLVTVSS

SEQ ID NO: 6346 - protein, 107 aa, Artificial Sequence; identical to SEQ ID NO: 6337
  Description of Artificial Sequence: Synthetic polypeptide
  VL of XENP017933

SEQ ID NO: 6347 - protein, 5 aa, Artificial Sequence
  Description of Artificial Sequence: Synthetic peptide
  XENP017933 vhCDR1
SYGMS

SEQ ID NO: 6348 - protein, 17 aa, Artificial Sequence
  Description of Artificial Sequence: Synthetic peptide
  XENP017933 vhCDR2
TISGGGRYTYYPDSVKG

SEQ ID NO: 6349 - protein, 8 aa, Artificial Sequence
  Description of Artificial Sequence: Synthetic peptide
  XENP017933 vhCDR3
YYDSSFDY

SEQ ID NO: 6350 - protein, 11 aa, Artificial Sequence
  Description of Artificial Sequence: Synthetic peptide
  XENP017933 vlCDR1
RASQDVGTAVA

SEQ ID NO: 6351 - protein, 7 aa, Artificial Sequence
  Description of Artificial Sequence: Synthetic peptide
  XENP017933 vlCDR2
WASTRHT

SEQ ID NO: 6352 - protein, 9 aa, Artificial Sequence
  Description of Artificial Sequence: Synthetic peptide
  XENP017933 vlCDR3
QHYSIYPWT

SEQ ID NO: 6353 - protein, 244 aa, Artificial Sequence
  Description of Artificial Sequence: Synthetic polypeptide
  XENP017934 6A3_H1.1_L3_scFv(GKPGS)4
EVQLLESGGGLVQPGGSLRLSCAASGFTFSSYGMSWVRQAPGKGLEWVSTISGGGRYTYYPDSVKGRFTISRDNSKNTLYLQMNSLRAEDTAVYYCASYYDSSFDYWGQGTLVTVSSGKPGSGKPGSGKPGSGKPGSDIVMTQSPSSLSASVGDRVTITCRASQDVGTAVAWYQQKPGKSPKLLIYWASTRHTGVPDRFTGSGSGTDFTLTISSLQPEDFATYFCQHYSIYPWTFGGGTKVEIK

SEQ ID NO: 6354 - protein, 117 aa, Artificial Sequence
  Description of Artificial Sequence: Synthetic polypeptide
  VH of XENP017934
EVQLLESGGGLVQPGGSLRLSCAASGFTFSSYGMSWVRQAPGKGLEWVSTISGGGRYTYYPDSVKGRFTISRDNSKNTLYLQMNSLRAEDTAVYYCASYYDSSFDYWGQGTLVTVSS

SEQ ID NO: 6355 - protein, 107 aa, Artificial Sequence; identical to SEQ ID NO: 6337
  Description of Artificial Sequence: Synthetic polypeptide
  VL of XENP017934

SEQ ID NO: 6356 - protein, 5 aa, Artificial Sequence
  Description of Artificial Sequence: Synthetic peptide
  XENP017934 vhCDR1
SYGMS

SEQ ID NO: 6357 - protein, 17 aa, Artificial Sequence
  Description of Artificial Sequence: Synthetic peptide
  XENP017934 vhCDR2
TISGGGRYTYYPDSVKG

SEQ ID NO: 6358 - protein, 8 aa, Artificial Sequence
  Description of Artificial Sequence: Synthetic peptide
  XENP017934 vhCDR3
YYDSSFDY

SEQ ID NO: 6359 - protein, 11 aa, Artificial Sequence
  Description of Artificial Sequence: Synthetic peptide
  XENP017934 vlCDR1
RASQDVGTAVA

SEQ ID NO: 6360 - protein, 7 aa, Artificial Sequence
  Description of Artificial Sequence: Synthetic peptide
  XENP017934 vlCDR2
WASTRHT

SEQ ID NO: 6361 - protein, 9 aa, Artificial Sequence
  Description of Artificial Sequence: Synthetic peptide
  XENP017934 vlCDR3
QHYSIYPWT

SEQ ID NO: 6362 - protein, 249 aa, Artificial Sequence
  Description of Artificial Sequence: Synthetic polypeptide
  XENP018493 1G6_H1.1_L1_scFv(GKPGS)4
QVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6363 - protein, 122 aa, Artificial Sequence
  Description of Artificial Sequence: Synthetic polypeptide
  VH of XENP018493
QVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6364 - protein, 107 aa, Artificial Sequence; identical to SEQ ID NO: 6247
  Description of Artificial Sequence: Synthetic polypeptide
  VL of XENP018493

SEQ ID NO: 6365 - protein, 5 aa, Artificial Sequence
  Description of Artificial Sequence: Synthetic peptide
  XENP018493 vhCDR1
NYWMN

SEQ ID NO: 6366 - protein, 19 aa, Artificial Sequence
  Description of Artificial Sequence: Synthetic peptide
  XENP018493 vhCDR2
EIRLKSNNYATHYAEPVKG

SEQ ID NO: 6367 - protein, 11 aa, Artificial Sequence
  Description of Artificial Sequence: Synthetic peptide
  XENP018493 vhCDR3
YYGNYGGYFDV

SEQ ID NO: 6368 - protein, 11 aa, Artificial Sequence
  Description of Artificial Sequence: Synthetic peptide
  XENP018493 vlCDR1
RASQSVSNDVA

SEQ ID NO: 6369 - protein, 7 aa, Artificial Sequence
  Description of Artificial Sequence: Synthetic peptide
  XENP018493 vlCDR2
YASHRYT

SEQ ID NO: 6370 - protein, 9 aa, Artificial Sequence
  Description of Artificial Sequence: Synthetic peptide
  XENP018493 vlCDR3
QQDYSSPRT

SEQ ID NO: 6371 - protein, 249 aa, Artificial Sequence
  Description of Artificial Sequence: Synthetic polypeptide
  XENP018494 1G6_H1.2_L1_scFv(GKPGS)4
EVKLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6372 - protein, 122 aa, Artificial Sequence
  Description of Artificial Sequence: Synthetic polypeptide
  VH of XENP018494
EVKLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6373 - protein, 107 aa, Artificial Sequence; identical to SEQ ID NO: 6247
  Description of Artificial Sequence: Synthetic polypeptide
  VL of XENP018494

SEQ ID NO: 6374 - protein, 5 aa, Artificial Sequence
  Description of Artificial Sequence: Synthetic peptide
  XENP018494 vhCDR1
NYWMN

SEQ ID NO: 6375 - protein, 19 aa, Artificial Sequence
  Description of Artificial Sequence: Synthetic peptide
  XENP018494 vhCDR2
EIRLKSNNYATHYAEPVKG

SEQ ID NO: 6376 - protein, 11 aa, Artificial Sequence
  Description of Artificial Sequence: Synthetic peptide
  XENP018494 vhCDR3
YYGNYGGYFDV

SEQ ID NO: 6377 - protein, 11 aa, Artificial Sequence
  Description of Artificial Sequence: Synthetic peptide
  XENP018494 vlCDR1
RASQSVSNDVA

SEQ ID NO: 6378 - protein, 7 aa, Artificial Sequence
  Description of Artificial Sequence: Synthetic peptide
  XENP018494 vlCDR2
YASHRYT

SEQ ID NO: 6379 - protein, 9 aa, Artificial Sequence
  Description of Artificial Sequence: Synthetic peptide
  XENP018494 vlCDR3
QQDYSSPRT

SEQ ID NO: 6380 - protein, 249 aa, Artificial Sequence
  Description of Artificial Sequence: Synthetic polypeptide
  XENP018495 1G6_H1.3_L1_scFv(GKPGS)4
EVQLEESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6381 - protein, 122 aa, Artificial Sequence
  Description of Artificial Sequence: Synthetic polypeptide
  VH of XENP018495
EVQLEESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6382 - protein, 107 aa, Artificial Sequence; identical to SEQ ID NO: 6247
  Description of Artificial Sequence: Synthetic polypeptide
  VL of XENP018495

SEQ ID NO: 6383 - protein, 5 aa, Artificial Sequence
  Description of Artificial Sequence: Synthetic peptide
  XENP018495 vhCDR1
NYWMN

SEQ ID NO: 6384 - protein, 19 aa, Artificial Sequence
  Description of Artificial Sequence: Synthetic peptide
  XENP018495 vhCDR2
EIRLKSNNYATHYAEPVKG

SEQ ID NO: 6385 - protein, 11 aa, Artificial Sequence
  Description of Artificial Sequence: Synthetic peptide
  XENP018495 vhCDR3
YYGNYGGYFDV

SEQ ID NO: 6386 - protein, 11 aa, Artificial Sequence
  Description of Artificial Sequence: Synthetic peptide
  XENP018495 vlCDR1
RASQSVSNDVA

SEQ ID NO: 6387 - protein, 7 aa, Artificial Sequence
  Description of Artificial Sequence: Synthetic peptide
  XENP018495 vlCDR2
YASHRYT

SEQ ID NO: 6388 - protein, 9 aa, Artificial Sequence
  Description of Artificial Sequence: Synthetic peptide
  XENP018495 vlCDR3
QQDYSSPRT

SEQ ID NO: 6389 - protein, 249 aa, Artificial Sequence
  Description of Artificial Sequence: Synthetic polypeptide
  XENP018496 1G6_H1.4_L1_scFv(GKPGS)4
EVQLVESGGGLVQPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6390 - protein, 122 aa, Artificial Sequence
  Description of Artificial Sequence: Synthetic polypeptide
  VH of XENP018496
EVQLVESGGGLVQPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6391 - protein, 107 aa, Artificial Sequence; identical to SEQ ID NO: 6247
  Description of Artificial Sequence: Synthetic polypeptide
  VL of XENP018496

SEQ ID NO: 6392 - protein, 5 aa, Artificial Sequence
  Description of Artificial Sequence: Synthetic peptide
  XENP018496 vhCDR1
NYWMN

SEQ ID NO: 6393 - protein, 19 aa, Artificial Sequence
  Description of Artificial Sequence: Synthetic peptide
  XENP018496 vhCDR2
EIRLKSNNYATHYAEPVKG

SEQ ID NO: 6394 - protein, 11 aa, Artificial Sequence
  Description of Artificial Sequence: Synthetic peptide
  XENP018496 vhCDR3
YYGNYGGYFDV

SEQ ID NO: 6395 - protein, 11 aa, Artificial Sequence
  Description of Artificial Sequence: Synthetic peptide
  XENP018496 vlCDR1
RASQSVSNDVA

SEQ ID NO: 6396 - protein, 7 aa, Artificial Sequence
  Description of Artificial Sequence: Synthetic peptide
  XENP018496 vlCDR2
YASHRYT

SEQ ID NO: 6397 - protein, 9 aa, Artificial Sequence
  Description of Artificial Sequence: Synthetic peptide
  XENP018496 vlCDR3
QQDYSSPRT

SEQ ID NO: 6398 - protein, 249 aa, Artificial Sequence
  Description of Artificial Sequence: Synthetic polypeptide
  XENP018501 1G6_H1.5_L1_scFv(GKPGS)4
EVQLVESGGGLVRPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6399 - protein, 122 aa, Artificial Sequence
  Description of Artificial Sequence: Synthetic polypeptide
  VH of XENP018501
EVQLVESGGGLVRPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6400 - protein, 107 aa, Artificial Sequence; identical to SEQ ID NO: 6247
  Description of Artificial Sequence: Synthetic polypeptide
  VL of XENP018501

SEQ ID NO: 6401 - protein, 5 aa, Artificial Sequence
  Description of Artificial Sequence: Synthetic peptide
  XENP018501 vhCDR1
NYWMN

SEQ ID NO: 6402 - protein, 19 aa, Artificial Sequence
  Description of Artificial Sequence: Synthetic peptide
  XENP018501 vhCDR2
EIRLKSNNYATHYAEPVKG

SEQ ID NO: 6403 - protein, 11 aa, Artificial Sequence
  Description of Artificial Sequence: Synthetic peptide
  XENP018501 vhCDR3
YYGNYGGYFDV

SEQ ID NO: 6404 - protein, 11 aa, Artificial Sequence
  Description of Artificial Sequence: Synthetic peptide
  XENP018501 vlCDR1
RASQSVSNDVA

SEQ ID NO: 6405 - protein, 7 aa, Artificial Sequence
  Description of Artificial Sequence: Synthetic peptide
  XENP018501 vlCDR2
YASHRYT

SEQ ID NO: 6406 - protein, 9 aa, Artificial Sequence
  Description of Artificial Sequence: Synthetic peptide
  XENP018501 vlCDR3
QQDYSSPRT

SEQ ID NO: 6407 - protein, 249 aa, Artificial Sequence
  Description of Artificial Sequence: Synthetic polypeptide
  XENP018502 1G6_H1.6_L1_scFv(GKPGS)4
EVQLVESGGGLVKPGGSMRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6408 - protein, 122 aa, Artificial Sequence
  Description of Artificial Sequence: Synthetic polypeptide
  VH of XENP018502
EVQLVESGGGLVKPGGSMRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6409 - protein, 107 aa, Artificial Sequence; identical to SEQ ID NO: 6247
  Description of Artificial Sequence: Synthetic polypeptide
  VL of XENP018502

SEQ ID NO: 6410 - protein, 5 aa, Artificial Sequence
  Description of Artificial Sequence: Synthetic peptide
  XENP018502 vhCDR1
NYWMN

SEQ ID NO: 6411 - protein, 19 aa, Artificial Sequence
  Description of Artificial Sequence: Synthetic peptide
  XENP018502 vhCDR2
EIRLKSNNYATHYAEPVKG

SEQ ID NO: 6412 - protein, 11 aa, Artificial Sequence
  Description of Artificial Sequence: Synthetic peptide
  XENP018502 vhCDR3
YYGNYGGYFDV

SEQ ID NO: 6413 - protein, 11 aa, Artificial Sequence
  Description of Artificial Sequence: Synthetic peptide
  XENP018502 vlCDR1
RASQSVSNDVA

SEQ ID NO: 6414 - protein, 7 aa, Artificial Sequence
  Description of Artificial Sequence: Synthetic peptide
  XENP018502 vlCDR2
YASHRYT

SEQ ID NO: 6415 - protein, 9 aa, Artificial Sequence
  Description of Artificial Sequence: Synthetic peptide
  XENP018502 vlCDR3
QQDYSSPRT

SEQ ID NO: 6416 - protein, 249 aa, Artificial Sequence
  Description of Artificial Sequence: Synthetic polypeptide
  XENP018503 1G6_H1.7_L1_scFv(GKPGS)4
EVQLVESGGGLVKPGGSLKLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6417 - protein, 122 aa, Artificial Sequence
  Description of Artificial Sequence: Synthetic polypeptide
  VH of XENP018503
EVQLVESGGGLVKPGGSLKLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6418 - protein, 107 aa, Artificial Sequence; identical to SEQ ID NO: 6247
  Description of Artificial Sequence: Synthetic polypeptide
  VL of XENP018503

SEQ ID NO: 6419 - protein, 5 aa, Artificial Sequence
  Description of Artificial Sequence: Synthetic peptide
  XENP018503 vhCDR1
NYWMN

SEQ ID NO: 6420 - protein, 19 aa, Artificial Sequence
  Description of Artificial Sequence: Synthetic peptide
  XENP018503 vhCDR2
EIRLKSNNYATHYAEPVKG

SEQ ID NO: 6421 - protein, 11 aa, Artificial Sequence
  Description of Artificial Sequence: Synthetic peptide
  XENP018503 vhCDR3
YYGNYGGYFDV

SEQ ID NO: 6422 - protein, 11 aa, Artificial Sequence
  Description of Artificial Sequence: Synthetic peptide
  XENP018503 vlCDR1
RASQSVSNDVA

SEQ ID NO: 6423 - protein, 7 aa, Artificial Sequence
  Description of Artificial Sequence: Synthetic peptide
  XENP018503 vlCDR2
YASHRYT

SEQ ID NO: 6424 - protein, 9 aa, Artificial Sequence
  Description of Artificial Sequence: Synthetic peptide
  XENP018503 vlCDR3
QQDYSSPRT

SEQ ID NO: 6425 - protein, 249 aa, Artificial Sequence
  Description of Artificial Sequence: Synthetic polypeptide
  XENP018504 1G6_H1.8_L1_scFv(GKPGS)4
EVQLVESGGGLVKPGGSLRLSCVASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6426 - protein, 122 aa, Artificial Sequence
  Description of Artificial Sequence: Synthetic polypeptide
  VH of XENP018504
EVQLVESGGGLVKPGGSLRLSCVASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6427 - protein, 107 aa, Artificial Sequence; identical to SEQ ID NO: 6247
  Description of Artificial Sequence: Synthetic polypeptide
  VL of XENP018504

SEQ ID NO: 6428 - protein, 5 aa, Artificial Sequence
  Description of Artificial Sequence: Synthetic peptide
  XENP018504 vhCDR1
NYWMN

SEQ ID NO: 6429 - protein, 19 aa, Artificial Sequence
  Description of Artificial Sequence: Synthetic peptide
  XENP018504 vhCDR2
EIRLKSNNYATHYAEPVKG

SEQ ID NO: 6430 - protein, 11 aa, Artificial Sequence
  Description of Artificial Sequence: Synthetic peptide
  XENP018504 vhCDR3
YYGNYGGYFDV

SEQ ID NO: 6431 - protein, 11 aa, Artificial Sequence
  Description of Artificial Sequence: Synthetic peptide
  XENP018504 vlCDR1
RASQSVSNDVA

SEQ ID NO: 6432 - protein, 7 aa, Artificial Sequence
  Description of Artificial Sequence: Synthetic peptide
  XENP018504 vlCDR2
YASHRYT

SEQ ID NO: 6433 - protein, 9 aa, Artificial Sequence
  Description of Artificial Sequence: Synthetic peptide
  XENP018504 vlCDR3
QQDYSSPRT

SEQ ID NO: 6434 - protein, 249 aa, Artificial Sequence
  Description of Artificial Sequence: Synthetic polypeptide
  XENP018505 1G6_H1.9_L1_scFv(GKPGS)4
EVQLVESGGGLVKPGGSLRLSCAASGFTVSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6435 - protein, 122 aa, Artificial Sequence
  Description of Artificial Sequence: Synthetic polypeptide
  VH of XENP018505
EVQLVESGGGLVKPGGSLRLSCAASGFTVSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6436 - protein, 107 aa, Artificial Sequence; identical to SEQ ID NO: 6247
  Description of Artificial Sequence: Synthetic polypeptide
  VL of XENP018505

SEQ ID NO: 6437 - protein, 5 aa, Artificial Sequence
  Description of Artificial Sequence: Synthetic peptide
  XENP018505 vhCDR1
NYWMN

SEQ ID NO: 6438 - protein, 19 aa, Artificial Sequence
  Description of Artificial Sequence: Synthetic peptide
  XENP018505 vhCDR2
EIRLKSNNYATHYAEPVKG

SEQ ID NO: 6439 - protein, 11 aa, Artificial Sequence
  Description of Artificial Sequence: Synthetic peptide
  XENP018505 vhCDR3
YYGNYGGYFDV

SEQ ID NO: 6440 - protein, 11 aa, Artificial Sequence
  Description of Artificial Sequence: Synthetic peptide
  XENP018505 vlCDR1
RASQSVSNDVA

SEQ ID NO: 6441 - protein, 7 aa, Artificial Sequence
  Description of Artificial Sequence: Synthetic peptide
  XENP018505 vlCDR2
YASHRYT

SEQ ID NO: 6442 - protein, 9 aa, Artificial Sequence
  Description of Artificial Sequence: Synthetic peptide
  XENP018505 vlCDR3
QQDYSSPRT

SEQ ID NO: 6443 - protein, 249 aa, Artificial Sequence
  Description of Artificial Sequence: Synthetic polypeptide
  XENP018506 1G6_H1.10_L1_scFv(GKPGS)4
EVQLVESGGGLVKPGGSLRLSCAASGFTFTNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6444 - protein, 122 aa, Artificial Sequence
  Description of Artificial Sequence: Synthetic polypeptide
  VH of XENP018506
EVQLVESGGGLVKPGGSLRLSCAASGFTFTNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6445 - protein, 107 aa, Artificial Sequence; identical to SEQ ID NO: 6247
  Description of Artificial Sequence: Synthetic polypeptide
  VL of XENP018506

SEQ ID NO: 6446 - protein, 5 aa, Artificial Sequence
  Description of Artificial Sequence: Synthetic peptide
  XENP018506 vhCDR1
NYWMN

SEQ ID NO: 6447 - protein, 19 aa, Artificial Sequence
  Description of Artificial Sequence: Synthetic peptide
  XENP018506 vhCDR2
EIRLKSNNYATHYAEPVKG

SEQ ID NO: 6448 - protein, 11 aa, Artificial Sequence
  Description of Artificial Sequence: Synthetic peptide
  XENP018506 vhCDR3
YYGNYGGYFDV

SEQ ID NO: 6449 - protein, 11 aa, Artificial Sequence
  Description of Artificial Sequence: Synthetic peptide
  XENP018506 vlCDR1
RASQSVSNDVA

SEQ ID NO: 6450 - protein, 7 aa, Artificial Sequence
  Description of Artificial Sequence: Synthetic peptide
  XENP018506 vlCDR2
YASHRYT

SEQ ID NO: 6451 - protein, 9 aa, Artificial Sequence
  Description of Artificial Sequence: Synthetic peptide
  XENP018506 vlCDR3
QQDYSSPRT

SEQ ID NO: 6452 - protein, 249 aa, Artificial Sequence
  Description of Artificial Sequence: Synthetic polypeptide
  XENP018507 1G6_H1.11_L1_scFv(GKPGS)4
EVQLVESGGGLVKPGGSLRLSCAASGFTFANYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6453 - protein, 122 aa, Artificial Sequence
  Description of Artificial Sequence: Synthetic polypeptide
  VH of XENP018507
EVQLVESGGGLVKPGGSLRLSCAASGFTFANYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6454 - protein, 107 aa, Artificial Sequence; identical to SEQ ID NO: 6247
  Description of Artificial Sequence: Synthetic polypeptide
  VL of XENP018507

SEQ ID NO: 6455 - protein, 5 aa, Artificial Sequence
  Description of Artificial Sequence: Synthetic peptide
  XENP018507 vhCDR1
NYWMN

SEQ ID NO: 6456 - protein, 19 aa, Artificial Sequence
  Description of Artificial Sequence: Synthetic peptide
  XENP018507 vhCDR2
EIRLKSNNYATHYAEPVKG

SEQ ID NO: 6457 - protein, 11 aa, Artificial Sequence
  Description of Artificial Sequence: Synthetic peptide
  XENP018507 vhCDR3
YYGNYGGYFDV

SEQ ID NO: 6458 - protein, 11 aa, Artificial Sequence
  Description of Artificial Sequence: Synthetic peptide
  XENP018507 vlCDR1
RASQSVSNDVA

SEQ ID NO: 6459 - protein, 7 aa, Artificial Sequence
  Description of Artificial Sequence: Synthetic peptide
  XENP018507 vlCDR2
YASHRYT

SEQ ID NO: 6460 - protein, 9 aa, Artificial Sequence
  Description of Artificial Sequence: Synthetic peptide
  XENP018507 vlCDR3
QQDYSSPRT

SEQ ID NO: 6461 - protein, 249 aa, Artificial Sequence
  Description of Artificial Sequence: Synthetic polypeptide
  XENP018508 1G6_H1.12_L1_scFv(GKPGS)4
EVQLVESGGGLVKPGGSLRLSCAASGFTFQNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6462 - protein, 122 aa, Artificial Sequence
  Description of Artificial Sequence: Synthetic polypeptide
  VH of XENP018508
EVQLVESGGGLVKPGGSLRLSCAASGFTFQNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6463 - protein, 107 aa, Artificial Sequence; identical to SEQ ID NO: 6247
  Description of Artificial Sequence: Synthetic polypeptide
  VL of XENP018508

SEQ ID NO: 6464 - protein, 5 aa, Artificial Sequence
  Description of Artificial Sequence: Synthetic peptide
  XENP018508 vhCDR1
NYWMN

SEQ ID NO: 6465 - protein, 19 aa, Artificial Sequence
  Description of Artificial Sequence: Synthetic peptide
  XENP018508 vhCDR2
EIRLKSNNYATHYAEPVKG

SEQ ID NO: 6466 - protein, 11 aa, Artificial Sequence
  Description of Artificial Sequence: Synthetic peptide
  XENP018508 vhCDR3
YYGNYGGYFDV

SEQ ID NO: 6467 - protein, 11 aa, Artificial Sequence
  Description of Artificial Sequence: Synthetic peptide
  XENP018508 vlCDR1
RASQSVSNDVA

SEQ ID NO: 6468 - protein, 7 aa, Artificial Sequence
  Description of Artificial Sequence: Synthetic peptide
  XENP018508 vlCDR2
YASHRYT

SEQ ID NO: 6469 - protein, 9 aa, Artificial Sequence
  Description of Artificial Sequence: Synthetic peptide
  XENP018508 vlCDR3
QQDYSSPRT

SEQ ID NO: 6470 - protein, 249 aa, Artificial Sequence
  Description of Artificial Sequence: Synthetic polypeptide
  XENP018509 1G6_H1.13_L1_scFv(GKPGS)4
EVQLVESGGGLVKPGGSLRLSCAASGFTFGNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6471 - protein, 122 aa, Artificial Sequence
  Description of Artificial Sequence: Synthetic polypeptide
  VH of XENP018509
EVQLVESGGGLVKPGGSLRLSCAASGFTFGNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6472 - protein, 107 aa, Artificial Sequence; identical to SEQ ID NO: 6247
  Description of Artificial Sequence: Synthetic polypeptide
  VL of XENP018509

SEQ ID NO: 6473 - protein, 5 aa, Artificial Sequence
  Description of Artificial Sequence: Synthetic peptide
  XENP018509 vhCDR1
NYWMN

SEQ ID NO: 6474 - protein, 19 aa, Artificial Sequence
  Description of Artificial Sequence: Synthetic peptide
  XENP018509 vhCDR2
EIRLKSNNYATHYAEPVKG

SEQ ID NO: 6475 - protein, 11 aa, Artificial Sequence
  Description of Artificial Sequence: Synthetic peptide
  XENP018509 vhCDR3
YYGNYGGYFDV

SEQ ID NO: 6476 - protein, 11 aa, Artificial Sequence
  Description of Artificial Sequence: Synthetic peptide
  XENP018509 vlCDR1
RASQSVSNDVA

SEQ ID NO: 6477 - protein, 7 aa, Artificial Sequence
  Description of Artificial Sequence: Synthetic peptide
  XENP018509 vlCDR2
YASHRYT

SEQ ID NO: 6478 - protein, 9 aa, Artificial Sequence
  Description of Artificial Sequence: Synthetic peptide
  XENP018509 vlCDR3
QQDYSSPRT

SEQ ID NO: 6479 - protein, 249 aa, Artificial Sequence
  Description of Artificial Sequence: Synthetic polypeptide
  XENP018510 1G6_H1.14_L1_scFv(GKPGS)4
EVQLVESGGGLVKPGGSLRLSCAASGFTFVNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6480 - protein, 122 aa, Artificial Sequence
  Description of Artificial Sequence: Synthetic polypeptide
  VH of XENP018510
EVQLVESGGGLVKPGGSLRLSCAASGFTFVNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6481 - protein, 107 aa, Artificial Sequence; identical to SEQ ID NO: 6247
  Description of Artificial Sequence: Synthetic polypeptide
  VL of XENP018510

SEQ ID NO: 6482 - protein, 5 aa, Artificial Sequence
  Description of Artificial Sequence: Synthetic peptide
  XENP018510 vhCDR1
NYWMN

SEQ ID NO: 6483 - protein, 19 aa, Artificial Sequence
  Description of Artificial Sequence: Synthetic peptide
  XENP018510 vhCDR2
EIRLKSNNYATHYAEPVKG

SEQ ID NO: 6484 - protein, 11 aa, Artificial Sequence
  Description of Artificial Sequence: Synthetic peptide
  XENP018510 vhCDR3
YYGNYGGYFDV

SEQ ID NO: 6485 - protein, 11 aa, Artificial Sequence
  Description of Artificial Sequence: Synthetic peptide
  XENP018510 vlCDR1
RASQSVSNDVA

SEQ ID NO: 6486 - protein, 7 aa, Artificial Sequence
  Description of Artificial Sequence: Synthetic peptide
  XENP018510 vlCDR2
YASHRYT

SEQ ID NO: 6487 - protein, 9 aa, Artificial Sequence
  Description of Artificial Sequence: Synthetic peptide
  XENP018510 vlCDR3
QQDYSSPRT

SEQ ID NO: 6488 - protein, 249 aa, Artificial Sequence
  Description of Artificial Sequence: Synthetic polypeptide
  XENP018511 1G6_H1.15_L1_scFv(GKPGS)4
EVQLVESGGGLVKPGGSLRLSCAASGFTFHNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6489 - protein, 122 aa, Artificial Sequence
  Description of Artificial Sequence: Synthetic polypeptide
  VH of XENP018511
EVQLVESGGGLVKPGGSLRLSCAASGFTFHNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6490 - protein, 107 aa, Artificial Sequence; identical to SEQ ID NO: 6247
  Description of Artificial Sequence: Synthetic polypeptide
  VL of XENP018511

SEQ ID NO: 6491 - protein, 5 aa, Artificial Sequence
  Description of Artificial Sequence: Synthetic peptide
  XENP018511 vhCDR1
NYWMN

SEQ ID NO: 6492 - protein, 19 aa, Artificial Sequence
  Description of Artificial Sequence: Synthetic peptide
  XENP018511 vhCDR2
EIRLKSNNYATHYAEPVKG

SEQ ID NO: 6493 - protein, 11 aa, Artificial Sequence
  Description of Artificial Sequence: Synthetic peptide
  XENP018511 vhCDR3
YYGNYGGYFDV

SEQ ID NO: 6494 - protein, 11 aa, Artificial Sequence
  Description of Artificial Sequence: Synthetic peptide
  XENP018511 vlCDR1
RASQSVSNDVA

SEQ ID NO: 6495 - protein, 7 aa, Artificial Sequence
  Description of Artificial Sequence: Synthetic peptide
  XENP018511 vlCDR2
YASHRYT

SEQ ID NO: 6496 - protein, 9 aa, Artificial Sequence
  Description of Artificial Sequence: Synthetic peptide
  XENP018511 vlCDR3
QQDYSSPRT

SEQ ID NO: 6497 - protein, 249 aa, Artificial Sequence
  Description of Artificial Sequence: Synthetic polypeptide
  XENP018512 1G6_H1.16_L1_scFv(GKPGS)4
EVQLVESGGGLVKPGGSLRLSCAASGFTFDNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6498 - protein, 122 aa, Artificial Sequence
  Description of Artificial Sequence: Synthetic polypeptide
  VH of XENP018512
EVQLVESGGGLVKPGGSLRLSCAASGFTFDNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6499 - protein, 107 aa, Artificial Sequence; identical to SEQ ID NO: 6247
  Description of Artificial Sequence: Synthetic polypeptide
  VL of XENP018512

SEQ ID NO: 6500 - protein, 5 aa, Artificial Sequence
  Description of Artificial Sequence: Synthetic peptide
  XENP018512 vhCDR1
NYWMN

SEQ ID NO: 6501 - protein, 19 aa, Artificial Sequence
  Description of Artificial Sequence: Synthetic peptide
  XENP018512 vhCDR2
EIRLKSNNYATHYAEPVKG

SEQ ID NO: 6502 - protein, 11 aa, Artificial Sequence
  Description of Artificial Sequence: Synthetic peptide
  XENP018512 vhCDR3
YYGNYGGYFDV

SEQ ID NO: 6503 - protein, 11 aa, Artificial Sequence
  Description of Artificial Sequence: Synthetic peptide
  XENP018512 vlCDR1
RASQSVSNDVA

SEQ ID NO: 6504 - protein, 7 aa, Artificial Sequence
  Description of Artificial Sequence: Synthetic peptide
  XENP018512 vlCDR2
YASHRYT

SEQ ID NO: 6505 - protein, 9 aa, Artificial Sequence
  Description of Artificial Sequence: Synthetic peptide
  XENP018512 vlCDR3
QQDYSSPRT

SEQ ID NO: 6506 - protein, 249 aa, Artificial Sequence
  Description of Artificial Sequence: Synthetic polypeptide
  XENP018513 1G6_H1.17_L1_scFv(GKPGS)4
EVQLVESGGGLVKPGGSLRLSCAASGFTFKNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6507 - protein, 122 aa, Artificial Sequence
  Description of Artificial Sequence: Synthetic polypeptide
  VH of XENP018513
EVQLVESGGGLVKPGGSLRLSCAASGFTFKNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6508 - protein, 107 aa, Artificial Sequence; identical to SEQ ID NO: 6247
  Description of Artificial Sequence: Synthetic polypeptide
  VL of XENP018513

SEQ ID NO: 6509 - protein, 5 aa, Artificial Sequence
  Description of Artificial Sequence: Synthetic peptide
  XENP018513 vhCDR1
NYWMN

SEQ ID NO: 6510 - protein, 19 aa, Artificial Sequence
  Description of Artificial Sequence: Synthetic peptide
  XENP018513 vhCDR2
EIRLKSNNYATHYAEPVKG

SEQ ID NO: 6511 - protein, 11 aa, Artificial Sequence
  Description of Artificial Sequence: Synthetic peptide
  XENP018513 vhCDR3
YYGNYGGYFDV

SEQ ID NO: 6512 - protein, 11 aa, Artificial Sequence
  Description of Artificial Sequence: Synthetic peptide
  XENP018513 vlCDR1
RASQSVSNDVA

SEQ ID NO: 6513 - protein, 7 aa, Artificial Sequence
  Description of Artificial Sequence: Synthetic peptide
  XENP018513 vlCDR2
YASHRYT

SEQ ID NO: 6514 - protein, 9 aa, Artificial Sequence
  Description of Artificial Sequence: Synthetic peptide
  XENP018513 vlCDR3
QQDYSSPRT

SEQ ID NO: 6515 - protein, 249 aa, Artificial Sequence
  Description of Artificial Sequence: Synthetic polypeptide
  XENP018514 1G6_H1.18_L1_scFv(GKPGS)4
EVQLVESGGGLVKPGGSLRLSCAASGFTFYNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6516 - protein, 122 aa, Artificial Sequence
  Description of Artificial Sequence: Synthetic polypeptide
  VH of XENP018514
EVQLVESGGGLVKPGGSLRLSCAASGFTFYNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6517 - protein, 107 aa, Artificial Sequence; identical to SEQ ID NO: 6247
  Description of Artificial Sequence: Synthetic polypeptide
  VL of XENP018514

SEQ ID NO: 6518 - protein, 5 aa, Artificial Sequence
  Description of Artificial Sequence: Synthetic peptide
  XENP018514 vhCDR1
NYWMN

SEQ ID NO: 6519 - protein, 19 aa, Artificial Sequence
  Description of Artificial Sequence: Synthetic peptide
  XENP018514 vhCDR2
EIRLKSNNYATHYAEPVKG

SEQ ID NO: 6520 - protein, 11 aa, Artificial Sequence
  Description of Artificial Sequence: Synthetic peptide
  XENP018514 vhCDR3
YYGNYGGYFDV

SEQ ID NO: 6521 - protein, 11 aa, Artificial Sequence
  Description of Artificial Sequence: Synthetic peptide
  XENP018514 vlCDR1
RASQSVSNDVA

SEQ ID NO: 6522 - protein, 7 aa, Artificial Sequence
  Description of Artificial Sequence: Synthetic peptide
  XENP018514 vlCDR2
YASHRYT

SEQ ID NO: 6523 - protein, 9 aa, Artificial Sequence
  Description of Artificial Sequence: Synthetic peptide
  XENP018514 vlCDR3
QQDYSSPRT

SEQ ID NO: 6524 - protein, 249 aa, Artificial Sequence
  Description of Artificial Sequence: Synthetic polypeptide
  XENP018515 1G6_H1.19_L1_scFv(GKPGS)4
EVQLVESGGGLVKPGGSLRLSCAASGFTFSDYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6525 - protein, 122 aa, Artificial Sequence
  Description of Artificial Sequence: Synthetic polypeptide
  VH of XENP018515
EVQLVESGGGLVKPGGSLRLSCAASGFTFSDYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6526 - protein, 107 aa, Artificial Sequence; identical to SEQ ID NO: 6247
  Description of Artificial Sequence: Synthetic polypeptide
  VL of XENP018515

SEQ ID NO: 6527 - protein, 5 aa, Artificial Sequence
  Description of Artificial Sequence: Synthetic peptide
  XENP018515 vhCDR1
DYWMN

SEQ ID NO: 6528 - protein, 19 aa, Artificial Sequence
  Description of Artificial Sequence: Synthetic peptide
  XENP018515 vhCDR2
EIRLKSNNYATHYAEPVKG

SEQ ID NO: 6529 - protein, 11 aa, Artificial Sequence
  Description of Artificial Sequence: Synthetic peptide
  XENP018515 vhCDR3
YYGNYGGYFDV

SEQ ID NO: 6530 - protein, 11 aa, Artificial Sequence
  Description of Artificial Sequence: Synthetic peptide
  XENP018515 vlCDR1
RASQSVSNDVA

SEQ ID NO: 6531 - protein, 7 aa, Artificial Sequence
  Description of Artificial Sequence: Synthetic peptide
  XENP018515 vlCDR2
YASHRYT

SEQ ID NO: 6532 - protein, 9 aa, Artificial Sequence
  Description of Artificial Sequence: Synthetic peptide
  XENP018515 vlCDR3
QQDYSSPRT

SEQ ID NO: 6533 - protein, 249 aa, Artificial Sequence
  Description of Artificial Sequence: Synthetic polypeptide
  XENP018516 1G6_H1.20_L1_scFv(GKPGS)4
EVQLVESGGGLVKPGGSLRLSCAASGFTFSHYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6534 - protein, 122 aa, Artificial Sequence
  Description of Artificial Sequence: Synthetic polypeptide
  VH of XENP018516
EVQLVESGGGLVKPGGSLRLSCAASGFTFSHYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6535 - protein, 107 aa, Artificial Sequence; identical to SEQ ID NO: 6247
  Description of Artificial Sequence: Synthetic polypeptide
  VL of XENP018516

SEQ ID NO: 6536 - protein, 5 aa, Artificial Sequence
  Description of Artificial Sequence: Synthetic peptide
  XENP018516 vhCDR1
HYWMN

SEQ ID NO: 6537 - protein, 19 aa, Artificial Sequence
  Description of Artificial Sequence: Synthetic peptide
  XENP018516 vhCDR2
EIRLKSNNYATHYAEPVKG

SEQ ID NO: 6538 - protein, 11 aa, Artificial Sequence
  Description of Artificial Sequence: Synthetic peptide
  XENP018516 vhCDR3
YYGNYGGYFDV

SEQ ID NO: 6539 - protein, 11 aa, Artificial Sequence
  Description of Artificial Sequence: Synthetic peptide
  XENP018516 vlCDR1
RASQSVSNDVA

SEQ ID NO: 6540 - protein, 7 aa, Artificial Sequence
  Description of Artificial Sequence: Synthetic peptide
  XENP018516 vlCDR2
YASHRYT

SEQ ID NO: 6541 - protein, 9 aa, Artificial Sequence
  Description of Artificial Sequence: Synthetic peptide
  XENP018516 vlCDR3
QQDYSSPRT

SEQ ID NO: 6542 - protein, 249 aa, Artificial Sequence
  Description of Artificial Sequence: Synthetic polypeptide
  XENP018517 1G6_H1.21_L1_scFv(GKPGS)4
EVQLVESGGGLVKPGGSLRLSCAASGFTFSEYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6543 - protein, 122 aa, Artificial Sequence
  Description of Artificial Sequence: Synthetic polypeptide
  VH of XENP018517
EVQLVESGGGLVKPGGSLRLSCAASGFTFSEYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6544 - protein, 107 aa, Artificial Sequence; identical to SEQ ID NO: 6247
  Description of Artificial Sequence: Synthetic polypeptide
  VL of XENP018517

SEQ ID NO: 6545 - protein, 5 aa, Artificial Sequence
  Description of Artificial Sequence: Synthetic peptide
  XENP018517 vhCDR1
EYWMN

SEQ ID NO: 6546 - protein, 19 aa, Artificial Sequence
  Description of Artificial Sequence: Synthetic peptide
  XENP018517 vhCDR2
EIRLKSNNYATHYAEPVKG

SEQ ID NO: 6547 - protein, 11 aa, Artificial Sequence
  Description of Artificial Sequence: Synthetic peptide
  XENP018517 vhCDR3
YYGNYGGYFDV

SEQ ID NO: 6548 - protein, 11 aa, Artificial Sequence
  Description of Artificial Sequence: Synthetic peptide
  XENP018517 vlCDR1
RASQSVSNDVA

SEQ ID NO: 6549 - protein, 7 aa, Artificial Sequence
  Description of Artificial Sequence: Synthetic peptide
  XENP018517 vlCDR2
YASHRYT

SEQ ID NO: 6550 - protein, 9 aa, Artificial Sequence
  Description of Artificial Sequence: Synthetic peptide
  XENP018517 vlCDR3
QQDYSSPRT

SEQ ID NO: 6551 - protein, 249 aa, Artificial Sequence
  Description of Artificial Sequence: Synthetic polypeptide
  XENP018518 1G6_H1.22_L1_scFv(GKPGS)4
EVQLVESGGGLVKPGGSLRLSCAASGFTFSSYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6552 - protein, 122 aa, Artificial Sequence
  Description of Artificial Sequence: Synthetic polypeptide
  VH of XENP018518
EVQLVESGGGLVKPGGSLRLSCAASGFTFSSYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6553 - protein, 107 aa, Artificial Sequence; identical to SEQ ID NO: 6247
  Description of Artificial Sequence: Synthetic polypeptide
  VL of XENP018518

SEQ ID NO: 6554 - protein, 5 aa, Artificial Sequence
  Description of Artificial Sequence: Synthetic peptide
  XENP018518 vhCDR1
SYWMN

SEQ ID NO: 6555 - protein, 19 aa, Artificial Sequence
  Description of Artificial Sequence: Synthetic peptide
  XENP018518 vhCDR2
EIRLKSNNYATHYAEPVKG

SEQ ID NO: 6556 - protein, 11 aa, Artificial Sequence
  Description of Artificial Sequence: Synthetic peptide
  XENP018518 vhCDR3
YYGNYGGYFDV

SEQ ID NO: 6557 - protein, 11 aa, Artificial Sequence
  Description of Artificial Sequence: Synthetic peptide
  XENP018518 vlCDR1
RASQSVSNDVA

SEQ ID NO: 6558 - protein, 7 aa, Artificial Sequence
  Description of Artificial Sequence: Synthetic peptide
  XENP018518 vlCDR2
YASHRYT

SEQ ID NO: 6559 - protein, 9 aa, Artificial Sequence
  Description of Artificial Sequence: Synthetic peptide
  XENP018518 vlCDR3
QQDYSSPRT

SEQ ID NO: 6560 - protein, 249 aa, Artificial Sequence
  Description of Artificial Sequence: Synthetic polypeptide
  XENP018519 1G6_H1.23_L1_scFv(GKPGS)4
EVQLVESGGGLVKPGGSLRLSCAASGFTFSRYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6561 - protein, 122 aa, Artificial Sequence
  Description of Artificial Sequence: Synthetic polypeptide
  VH of XENP018519
EVQLVESGGGLVKPGGSLRLSCAASGFTFSRYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6562 - protein, 107 aa, Artificial Sequence; identical to SEQ ID NO: 6247
  Description of Artificial Sequence: Synthetic polypeptide
  VL of XENP018519

SEQ ID NO: 6563 - protein, 5 aa, Artificial Sequence
  Description of Artificial Sequence: Synthetic peptide
  XENP018519 vhCDR1
RYWMN

SEQ ID NO: 6564 - protein, 19 aa, Artificial Sequence
  Description of Artificial Sequence: Synthetic peptide
  XENP018519 vhCDR2
EIRLKSNNYATHYAEPVKG

SEQ ID NO: 6565 - protein, 11 aa, Artificial Sequence
  Description of Artificial Sequence: Synthetic peptide
  XENP018519 vhCDR3
YYGNYGGYFDV

SEQ ID NO: 6566 - protein, 11 aa, Artificial Sequence
  Description of Artificial Sequence: Synthetic peptide
  XENP018519 vlCDR1
RASQSVSNDVA

SEQ ID NO: 6567 - protein, 7 aa, Artificial Sequence
  Description of Artificial Sequence: Synthetic peptide
  XENP018519 vlCDR2
YASHRYT

SEQ ID NO: 6568 - protein, 9 aa, Artificial Sequence
  Description of Artificial Sequence: Synthetic peptide
  XENP018519 vlCDR3
QQDYSSPRT

SEQ ID NO: 6569 - protein, 249 aa, Artificial Sequence
  Description of Artificial Sequence: Synthetic polypeptide
  XENP018520 1G6_H1.24_L1_scFv(GKPGS)4
EVQLVESGGGLVKPGGSLRLSCAASGFTFSLYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6570 - protein, 122 aa, Artificial Sequence
  Description of Artificial Sequence: Synthetic polypeptide
  VH of XENP018520
EVQLVESGGGLVKPGGSLRLSCAASGFTFSLYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6571 - protein, 107 aa, Artificial Sequence; identical to SEQ ID NO: 6247
  Description of Artificial Sequence: Synthetic polypeptide
  VL of XENP018520

SEQ ID NO: 6572 - protein, 5 aa, Artificial Sequence
  Description of Artificial Sequence: Synthetic peptide
  XENP018520 vhCDR1
LYWMN

SEQ ID NO: 6573 - protein, 19 aa, Artificial Sequence
  Description of Artificial Sequence: Synthetic peptide
  XENP018520 vhCDR2
EIRLKSNNYATHYAEPVKG

SEQ ID NO: 6574 - protein, 11 aa, Artificial Sequence
  Description of Artificial Sequence: Synthetic peptide
  XENP018520 vhCDR3
YYGNYGGYFDV

SEQ ID NO: 6575 - protein, 11 aa, Artificial Sequence
  Description of Artificial Sequence: Synthetic peptide
  XENP018520 vlCDR1
RASQSVSNDVA

SEQ ID NO: 6576 - protein, 7 aa, Artificial Sequence
  Description of Artificial Sequence: Synthetic peptide
  XENP018520 vlCDR2
YASHRYT

SEQ ID NO: 6577 - protein, 9 aa, Artificial Sequence
  Description of Artificial Sequence: Synthetic peptide
  XENP018520 vlCDR3
QQDYSSPRT

SEQ ID NO: 6578 - protein, 249 aa, Artificial Sequence
  Description of Artificial Sequence: Synthetic polypeptide
  XENP018521 1G6_H1.25_L1_scFv(GKPGS)4
EVQLVESGGGLVKPGGSLRLSCAASGFTFSTYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6579 - protein, 122 aa, Artificial Sequence
  Description of Artificial Sequence: Synthetic polypeptide
  VH of XENP018521
EVQLVESGGGLVKPGGSLRLSCAASGFTFSTYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6580 - protein, 107 aa, Artificial Sequence; identical to SEQ ID NO: 6247
  Description of Artificial Sequence: Synthetic polypeptide
  VL of XENP018521

SEQ ID NO: 6581 - protein, 5 aa, Artificial Sequence
  Description of Artificial Sequence: Synthetic peptide
  XENP018521 vhCDR1
TYWMN

SEQ ID NO: 6582 - protein, 19 aa, Artificial Sequence
  Description of Artificial Sequence: Synthetic peptide
  XENP018521 vhCDR2
EIRLKSNNYATHYAEPVKG

SEQ ID NO: 6583 - protein, 11 aa, Artificial Sequence
  Description of Artificial Sequence: Synthetic peptide
  XENP018521 vhCDR3
YYGNYGGYFDV

SEQ ID NO: 6584 - protein, 11 aa, Artificial Sequence
  Description of Artificial Sequence: Synthetic peptide
  XENP018521 vlCDR1
RASQSVSNDVA

SEQ ID NO: 6585 - protein, 7 aa, Artificial Sequence
  Description of Artificial Sequence: Synthetic peptide
  XENP018521 vlCDR2
YASHRYT

SEQ ID NO: 6586 - protein, 9 aa, Artificial Sequence
  Description of Artificial Sequence: Synthetic peptide
  XENP018521 vlCDR3
QQDYSSPRT

SEQ ID NO: 6587 - protein, 249 aa, Artificial Sequence
  Description of Artificial Sequence: Synthetic polypeptide
  XENP018522 1G6_H1.26_L1_scFv(GKPGS)4
EVQLVESGGGLVKPGGSLRLSCAASGFTFSGYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6588 - protein, 122 aa, Artificial Sequence
  Description of Artificial Sequence: Synthetic polypeptide
  VH of XENP018522
EVQLVESGGGLVKPGGSLRLSCAASGFTFSGYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6589 - protein, 107 aa, Artificial Sequence; identical to SEQ ID NO: 6247
  Description of Artificial Sequence: Synthetic polypeptide
  VL of XENP018522

SEQ ID NO: 6590 - protein, 5 aa, Artificial Sequence
  Description of Artificial Sequence: Synthetic peptide
  XENP018522 vhCDR1
GYWMN

SEQ ID NO: 6591 - protein, 19 aa, Artificial Sequence
  Description of Artificial Sequence: Synthetic peptide
  XENP018522 vhCDR2
EIRLKSNNYATHYAEPVKG

SEQ ID NO: 6592 - protein, 11 aa, Artificial Sequence
  Description of Artificial Sequence: Synthetic peptide
  XENP018522 vhCDR3
YYGNYGGYFDV

SEQ ID NO: 6593 - protein, 11 aa, Artificial Sequence
  Description of Artificial Sequence: Synthetic peptide
  XENP018522 vlCDR1
RASQSVSNDVA

SEQ ID NO: 6594 - protein, 7 aa, Artificial Sequence
  Description of Artificial Sequence: Synthetic peptide
  XENP018522 vlCDR2
YASHRYT

SEQ ID NO: 6595 - protein, 9 aa, Artificial Sequence
  Description of Artificial Sequence: Synthetic peptide
  XENP018522 vlCDR3
QQDYSSPRT

SEQ ID NO: 6596 - protein, 249 aa, Artificial Sequence
  Description of Artificial Sequence: Synthetic polypeptide
  XENP018523 1G6_H1.27_L1_scFv(GKPGS)4
EVQLVESGGGLVKPGGSLRLSCAASGFTFSYYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6597 - protein, 122 aa, Artificial Sequence
  Description of Artificial Sequence: Synthetic polypeptide
  VH of XENP018523
EVQLVESGGGLVKPGGSLRLSCAASGFTFSYYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6598 - protein, 107 aa, Artificial Sequence; identical to SEQ ID NO: 6247
  Description of Artificial Sequence: Synthetic polypeptide
  VL of XENP018523

SEQ ID NO: 6599 - protein, 5 aa, Artificial Sequence
  Description of Artificial Sequence: Synthetic peptide
  XENP018523 vhCDR1
YYWMN

SEQ ID NO: 6600 - protein, 19 aa, Artificial Sequence
  Description of Artificial Sequence: Synthetic peptide
  XENP018523 vhCDR2
EIRLKSNNYATHYAEPVKG

SEQ ID NO: 6601 - protein, 11 aa, Artificial Sequence
  Description of Artificial Sequence: Synthetic peptide
  XENP018523 vhCDR3
YYGNYGGYFDV

SEQ ID NO: 6602 - protein, 11 aa, Artificial Sequence
  Description of Artificial Sequence: Synthetic peptide
  XENP018523 vlCDR1
RASQSVSNDVA

SEQ ID NO: 6603 - protein, 7 aa, Artificial Sequence
  Description of Artificial Sequence: Synthetic peptide
  XENP018523 vlCDR2
YASHRYT

SEQ ID NO: 6604 - protein, 9 aa, Artificial Sequence
  Description of Artificial Sequence: Synthetic peptide
  XENP018523 vlCDR3
QQDYSSPRT

SEQ ID NO: 6605 - protein, 249 aa, Artificial Sequence
  Description of Artificial Sequence: Synthetic polypeptide
  XENP018524 1G6_H1.28_L1_scFv(GKPGS)4
EVQLVESGGGLVKPGGSLRLSCAASGFTFSNFWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6606 - protein, 122 aa, Artificial Sequence
  Description of Artificial Sequence: Synthetic polypeptide
  VH of XENP018524
EVQLVESGGGLVKPGGSLRLSCAASGFTFSNFWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6607 - protein, 107 aa, Artificial Sequence; identical to SEQ ID NO: 6247
  Description of Artificial Sequence: Synthetic polypeptide
  VL of XENP018524

SEQ ID NO: 6608 - protein, 5 aa, Artificial Sequence
  Description of Artificial Sequence: Synthetic peptide
  XENP018524 vhCDR1
NFWMN

SEQ ID NO: 6609 - protein, 19 aa, Artificial Sequence
  Description of Artificial Sequence: Synthetic peptide
  XENP018524 vhCDR2
EIRLKSNNYATHYAEPVKG

SEQ ID NO: 6610 - protein, 11 aa, Artificial Sequence
  Description of Artificial Sequence: Synthetic peptide
  XENP018524 vhCDR3
YYGNYGGYFDV

SEQ ID NO: 6611 - protein, 11 aa, Artificial Sequence
  Description of Artificial Sequence: Synthetic peptide
  XENP018524 vlCDR1
RASQSVSNDVA

SEQ ID NO: 6612 - protein, 7 aa, Artificial Sequence
  Description of Artificial Sequence: Synthetic peptide
  XENP018524 vlCDR2
YASHRYT

SEQ ID NO: 6613 - protein, 9 aa, Artificial Sequence
  Description of Artificial Sequence: Synthetic peptide
  XENP018524 vlCDR3
QQDYSSPRT

SEQ ID NO: 6614 - protein, 249 aa, Artificial Sequence
  Description of Artificial Sequence: Synthetic polypeptide
  XENP018525 1G6_H1.29_L1_scFv(GKPGS)4
EVQLVESGGGLVKPGGSLRLSCAASGFTFSNHWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6615 - protein, 122 aa, Artificial Sequence
  Description of Artificial Sequence: Synthetic polypeptide
  VH of XENP018525
EVQLVESGGGLVKPGGSLRLSCAASGFTFSNHWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6616 - protein, 107 aa, Artificial Sequence; identical to SEQ ID NO: 6247
  Description of Artificial Sequence: Synthetic polypeptide
  VL of XENP018525

SEQ ID NO: 6617 - protein, 5 aa, Artificial Sequence
  Description of Artificial Sequence: Synthetic peptide
  XENP018525 vhCDR1
NHWMN

SEQ ID NO: 6618 - protein, 19 aa, Artificial Sequence
  Description of Artificial Sequence: Synthetic peptide
  XENP018525 vhCDR2
EIRLKSNNYATHYAEPVKG

SEQ ID NO: 6619 - protein, 11 aa, Artificial Sequence
  Description of Artificial Sequence: Synthetic peptide
  XENP018525 vhCDR3
YYGNYGGYFDV

SEQ ID NO: 6620 - protein, 11 aa, Artificial Sequence
  Description of Artificial Sequence: Synthetic peptide
  XENP018525 vlCDR1
RASQSVSNDVA

SEQ ID NO: 6621 - protein, 7 aa, Artificial Sequence
  Description of Artificial Sequence: Synthetic peptide
  XENP018525 vlCDR2
YASHRYT

SEQ ID NO: 6622 - protein, 9 aa, Artificial Sequence
  Description of Artificial Sequence: Synthetic peptide
  XENP018525 vlCDR3
QQDYSSPRT

SEQ ID NO: 6623 - protein, 249 aa, Artificial Sequence
  Description of Artificial Sequence: Synthetic polypeptide
  XENP018526 1G6_H1.30_L1_scFv(GKPGS)4
EVQLVESGGGLVKPGGSLRLSCAASGFTFSNLWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6624 - protein, 122 aa, Artificial Sequence
  Description of Artificial Sequence: Synthetic polypeptide
  VH of XENP018526
EVQLVESGGGLVKPGGSLRLSCAASGFTFSNLWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6625 - protein, 107 aa, Artificial Sequence; identical to SEQ ID NO: 6247
  Description of Artificial Sequence: Synthetic polypeptide
  VL of XENP018526

SEQ ID NO: 6626 - protein, 5 aa, Artificial Sequence
  Description of Artificial Sequence: Synthetic peptide
  XENP018526 vhCDR1
NLWMN

SEQ ID NO: 6627 - protein, 19 aa, Artificial Sequence
  Description of Artificial Sequence: Synthetic peptide
  XENP018526 vhCDR2
EIRLKSNNYATHYAEPVKG

SEQ ID NO: 6628 - protein, 11 aa, Artificial Sequence
  Description of Artificial Sequence: Synthetic peptide
  XENP018526 vhCDR3
YYGNYGGYFDV

SEQ ID NO: 6629 - protein, 11 aa, Artificial Sequence
  Description of Artificial Sequence: Synthetic peptide
  XENP018526 vlCDR1
RASQSVSNDVA

SEQ ID NO: 6630 - protein, 7 aa, Artificial Sequence
  Description of Artificial Sequence: Synthetic peptide
  XENP018526 vlCDR2
YASHRYT

SEQ ID NO: 6631 - protein, 9 aa, Artificial Sequence
  Description of Artificial Sequence: Synthetic peptide
  XENP018526 vlCDR3
QQDYSSPRT

SEQ ID NO: 6632 - protein, 249 aa, Artificial Sequence
  Description of Artificial Sequence: Synthetic polypeptide
  XENP018527 1G6_H1.31_L1_scFv(GKPGS)4
EVQLVESGGGLVKPGGSLRLSCAASGFTFSNWWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6633 - protein, 122 aa, Artificial Sequence
  Description of Artificial Sequence: Synthetic polypeptide
  VH of XENP018527
EVQLVESGGGLVKPGGSLRLSCAASGFTFSNWWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6634 - protein, 107 aa, Artificial Sequence; identical to SEQ ID NO: 6247
  Description of Artificial Sequence: Synthetic polypeptide
  VL of XENP018527

SEQ ID NO: 6635 - protein, 5 aa, Artificial Sequence
  Description of Artificial Sequence: Synthetic peptide
  XENP018527 vhCDR1
NWWMN

SEQ ID NO: 6636 - protein, 19 aa, Artificial Sequence
  Description of Artificial Sequence: Synthetic peptide
  XENP018527 vhCDR2
EIRLKSNNYATHYAEPVKG

SEQ ID NO: 6637 - protein, 11 aa, Artificial Sequence
  Description of Artificial Sequence: Synthetic peptide
  XENP018527 vhCDR3
YYGNYGGYFDV

SEQ ID NO: 6638 - protein, 11 aa, Artificial Sequence
  Description of Artificial Sequence: Synthetic peptide
  XENP018527 vlCDR1
RASQSVSNDVA

SEQ ID NO: 6639 - protein, 7 aa, Artificial Sequence
  Description of Artificial Sequence: Synthetic peptide
  XENP018527 vlCDR2
YASHRYT

SEQ ID NO: 6640 - protein, 9 aa, Artificial Sequence
  Description of Artificial Sequence: Synthetic peptide
  XENP018527 vlCDR3
QQDYSSPRT

SEQ ID NO: 6641 - protein, 249 aa, Artificial Sequence
  Description of Artificial Sequence: Synthetic polypeptide
  XENP018528 1G6_H1.32_L1_scFv(GKPGS)4
EVQLVESGGGLVKPGGSLRLSCAASGFTFSNVWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6642 - protein, 122 aa, Artificial Sequence
  Description of Artificial Sequence: Synthetic polypeptide
  VH of XENP018528
EVQLVESGGGLVKPGGSLRLSCAASGFTFSNVWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6643 - protein, 107 aa, Artificial Sequence; identical to SEQ ID NO: 6247
  Description of Artificial Sequence: Synthetic polypeptide
  VL of XENP018528

SEQ ID NO: 6644 - protein, 5 aa, Artificial Sequence
  Description of Artificial Sequence: Synthetic peptide
  XENP018528 vhCDR1
NVWMN

SEQ ID NO: 6645 - protein, 19 aa, Artificial Sequence
  Description of Artificial Sequence: Synthetic peptide
  XENP018528 vhCDR2
EIRLKSNNYATHYAEPVKG

SEQ ID NO: 6646 - protein, 11 aa, Artificial Sequence
  Description of Artificial Sequence: Synthetic peptide
  XENP018528 vhCDR3
YYGNYGGYFDV

SEQ ID NO: 6647 - protein, 11 aa, Artificial Sequence
  Description of Artificial Sequence: Synthetic peptide
  XENP018528 vlCDR1
RASQSVSNDVA

SEQ ID NO: 6648 - protein, 7 aa, Artificial Sequence
  Description of Artificial Sequence: Synthetic peptide
  XENP018528 vlCDR2
YASHRYT

SEQ ID NO: 6649 - protein, 9 aa, Artificial Sequence
  Description of Artificial Sequence: Synthetic peptide
  XENP018528 vlCDR3
QQDYSSPRT

SEQ ID NO: 6650 - protein, 249 aa, Artificial Sequence
  Description of Artificial Sequence: Synthetic polypeptide
  XENP018529 1G6_H1.33_L1_scFv(GKPGS)4
EVQLVESGGGLVKPGGSLRLSCAASGFTFSNAWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6651 - protein, 122 aa, Artificial Sequence
  Description of Artificial Sequence: Synthetic polypeptide
  VH of XENP018529
EVQLVESGGGLVKPGGSLRLSCAASGFTFSNAWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6652 - protein, 107 aa, Artificial Sequence; identical to SEQ ID NO: 6247
  Description of Artificial Sequence: Synthetic polypeptide
  VL of XENP018529

SEQ ID NO: 6653 - protein, 5 aa, Artificial Sequence
  Description of Artificial Sequence: Synthetic peptide
  XENP018529 vhCDR1
NAWMN

SEQ ID NO: 6654 - protein, 19 aa, Artificial Sequence
  Description of Artificial Sequence: Synthetic peptide
  XENP018529 vhCDR2
EIRLKSNNYATHYAEPVKG

SEQ ID NO: 6655 - protein, 11 aa, Artificial Sequence
  Description of Artificial Sequence: Synthetic peptide
  XENP018529 vhCDR3
YYGNYGGYFDV

SEQ ID NO: 6656 - protein, 11 aa, Artificial Sequence
  Description of Artificial Sequence: Synthetic peptide
  XENP018529 vlCDR1
RASQSVSNDVA

SEQ ID NO: 6657 - protein, 7 aa, Artificial Sequence
  Description of Artificial Sequence: Synthetic peptide
  XENP018529 vlCDR2
YASHRYT

SEQ ID NO: 6658 - protein, 9 aa, Artificial Sequence
  Description of Artificial Sequence: Synthetic peptide
  XENP018529 vlCDR3
QQDYSSPRT

SEQ ID NO: 6659 - protein, 249 aa, Artificial Sequence
  Description of Artificial Sequence: Synthetic polypeptide
  XENP018530 1G6_H1.34_L1_scFv(GKPGS)4
EVQLVESGGGLVKPGGSLRLSCAASGFTFSNQWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6660 - protein, 122 aa, Artificial Sequence
  Description of Artificial Sequence: Synthetic polypeptide
  VH of XENP018530
EVQLVESGGGLVKPGGSLRLSCAASGFTFSNQWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6661 - protein, 107 aa, Artificial Sequence; identical to SEQ ID NO: 6247
  Description of Artificial Sequence: Synthetic polypeptide
  VL of XENP018530

SEQ ID NO: 6662 - protein, 5 aa, Artificial Sequence
  Description of Artificial Sequence: Synthetic peptide
  XENP018530 vhCDR1
NQWMN

SEQ ID NO: 6663 - protein, 19 aa, Artificial Sequence
  Description of Artificial Sequence: Synthetic peptide
  XENP018530 vhCDR2
EIRLKSNNYATHYAEPVKG

SEQ ID NO: 6664 - protein, 11 aa, Artificial Sequence
  Description of Artificial Sequence: Synthetic peptide
  XENP018530 vhCDR3
YYGNYGGYFDV

SEQ ID NO: 6665 - protein, 11 aa, Artificial Sequence
  Description of Artificial Sequence: Synthetic peptide
  XENP018530 vlCDR1
RASQSVSNDVA

SEQ ID NO: 6666 - protein, 7 aa, Artificial Sequence
  Description of Artificial Sequence: Synthetic peptide
  XENP018530 vlCDR2
YASHRYT

SEQ ID NO: 6667 - protein, 9 aa, Artificial Sequence
  Description of Artificial Sequence: Synthetic peptide
  XENP018530 vlCDR3
QQDYSSPRT

SEQ ID NO: 6668 - protein, 249 aa, Artificial Sequence
  Description of Artificial Sequence: Synthetic polypeptide
  XENP018531 1G6_H1.35_L1_scFv(GKPGS)4
EVQLVESGGGLVKPGGSLRLSCAASGFTFSNDWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6669 - protein, 122 aa, Artificial Sequence
  Description of Artificial Sequence: Synthetic polypeptide
  VH of XENP018531
EVQLVESGGGLVKPGGSLRLSCAASGFTFSNDWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6670 - protein, 107 aa, Artificial Sequence; identical to SEQ ID NO: 6247
  Description of Artificial Sequence: Synthetic polypeptide
  VL of XENP018531

SEQ ID NO: 6671 - protein, 5 aa, Artificial Sequence
  Description of Artificial Sequence: Synthetic peptide
  XENP018531 vhCDR1
NDWMN

SEQ ID NO: 6672 - protein, 19 aa, Artificial Sequence
  Description of Artificial Sequence: Synthetic peptide
  XENP018531 vhCDR2
EIRLKSNNYATHYAEPVKG

SEQ ID NO: 6673 - protein, 11 aa, Artificial Sequence
  Description of Artificial Sequence: Synthetic peptide
  XENP018531 vhCDR3
YYGNYGGYFDV

SEQ ID NO: 6674 - protein, 11 aa, Artificial Sequence
  Description of Artificial Sequence: Synthetic peptide
  XENP018531 vlCDR1
RASQSVSNDVA

SEQ ID NO: 6675 - protein, 7 aa, Artificial Sequence
  Description of Artificial Sequence: Synthetic peptide
  XENP018531 vlCDR2
YASHRYT

SEQ ID NO: 6676 - protein, 9 aa, Artificial Sequence
  Description of Artificial Sequence: Synthetic peptide
  XENP018531 vlCDR3
QQDYSSPRT

SEQ ID NO: 6677 - protein, 249 aa, Artificial Sequence
  Description of Artificial Sequence: Synthetic polypeptide
  XENP018532 1G6_H1.36_L1_scFv(GKPGS)4
EVQLVESGGGLVKPGGSLRLSCAASGFTFSNKWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6678 - protein, 122 aa, Artificial Sequence
  Description of Artificial Sequence: Synthetic polypeptide
  VH of XENP018532
EVQLVESGGGLVKPGGSLRLSCAASGFTFSNKWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6679 - protein, 107 aa, Artificial Sequence; identical to SEQ ID NO: 6247
  Description of Artificial Sequence: Synthetic polypeptide
  VL of XENP018532

SEQ ID NO: 6680 - protein, 5 aa, Artificial Sequence
  Description of Artificial Sequence: Synthetic peptide
  XENP018532 vhCDR1
NKWMN

SEQ ID NO: 6681 - protein, 19 aa, Artificial Sequence
  Description of Artificial Sequence: Synthetic peptide
  XENP018532 vhCDR2
EIRLKSNNYATHYAEPVKG

SEQ ID NO: 6682 - protein, 11 aa, Artificial Sequence
  Description of Artificial Sequence: Synthetic peptide
  XENP018532 vhCDR3
YYGNYGGYFDV

SEQ ID NO: 6683 - protein, 11 aa, Artificial Sequence
  Description of Artificial Sequence: Synthetic peptide
  XENP018532 vlCDR1
RASQSVSNDVA

SEQ ID NO: 6684 - protein, 7 aa, Artificial Sequence
  Description of Artificial Sequence: Synthetic peptide
  XENP018532 vlCDR2
YASHRYT

SEQ ID NO: 6685 - protein, 9 aa, Artificial Sequence
  Description of Artificial Sequence: Synthetic peptide
  XENP018532 vlCDR3
QQDYSSPRT

SEQ ID NO: 6686 - protein, 249 aa, Artificial Sequence
  Description of Artificial Sequence: Synthetic polypeptide
  XENP018533 1G6_H1.37_L1_scFv(GKPGS)4
EVQLVESGGGLVKPGGSLRLSCAASGFTFSNYGMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6687 - protein, 122 aa, Artificial Sequence
  Description of Artificial Sequence: Synthetic polypeptide
  VH of XENP018533
EVQLVESGGGLVKPGGSLRLSCAASGFTFSNYGMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6688 - protein, 107 aa, Artificial Sequence; identical to SEQ ID NO: 6247
  Description of Artificial Sequence: Synthetic polypeptide
  VL of XENP018533

SEQ ID NO: 6689 - protein, 5 aa, Artificial Sequence
  Description of Artificial Sequence: Synthetic peptide
  XENP018533 vhCDR1
NYGMN

SEQ ID NO: 6690 - protein, 19 aa, Artificial Sequence
  Description of Artificial Sequence: Synthetic peptide
  XENP018533 vhCDR2
EIRLKSNNYATHYAEPVKG

SEQ ID NO: 6691 - protein, 11 aa, Artificial Sequence
  Description of Artificial Sequence: Synthetic peptide
  XENP018533 vhCDR3
YYGNYGGYFDV

SEQ ID NO: 6692 - protein, 11 aa, Artificial Sequence
  Description of Artificial Sequence: Synthetic peptide
  XENP018533 vlCDR1
RASQSVSNDVA

SEQ ID NO: 6693 - protein, 7 aa, Artificial Sequence
  Description of Artificial Sequence: Synthetic peptide
  XENP018533 vlCDR2
YASHRYT

SEQ ID NO: 6694 - protein, 9 aa, Artificial Sequence
  Description of Artificial Sequence: Synthetic peptide
  XENP018533 vlCDR3
QQDYSSPRT

SEQ ID NO: 6695 - protein, 249 aa, Artificial Sequence
  Description of Artificial Sequence: Synthetic polypeptide
  XENP018534 1G6_H1.38_L1_scFv(GKPGS)4
EVQLVESGGGLVKPGGSLRLSCAASGFTFSNYAMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6696 - protein, 122 aa, Artificial Sequence
  Description of Artificial Sequence: Synthetic polypeptide
  VH of XENP018534
EVQLVESGGGLVKPGGSLRLSCAASGFTFSNYAMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6697 - protein, 107 aa, Artificial Sequence; identical to SEQ ID NO: 6247
  Description of Artificial Sequence: Synthetic polypeptide
  VL of XENP018534

SEQ ID NO: 6698 - protein, 5 aa, Artificial Sequence
  Description of Artificial Sequence: Synthetic peptide
  XENP018534 vhCDR1
NYAMN

SEQ ID NO: 6699 - protein, 19 aa, Artificial Sequence
  Description of Artificial Sequence: Synthetic peptide
  XENP018534 vhCDR2
EIRLKSNNYATHYAEPVKG

SEQ ID NO: 6700 - protein, 11 aa, Artificial Sequence
  Description of Artificial Sequence: Synthetic peptide
  XENP018534 vhCDR3
YYGNYGGYFDV

SEQ ID NO: 6701 - protein, 11 aa, Artificial Sequence
  Description of Artificial Sequence: Synthetic peptide
  XENP018534 vlCDR1
RASQSVSNDVA

SEQ ID NO: 6702 - protein, 7 aa, Artificial Sequence
  Description of Artificial Sequence: Synthetic peptide
  XENP018534 vlCDR2
YASHRYT

SEQ ID NO: 6703 - protein, 9 aa, Artificial Sequence
  Description of Artificial Sequence: Synthetic peptide
  XENP018534 vlCDR3
QQDYSSPRT

SEQ ID NO: 6704 - protein, 249 aa, Artificial Sequence
  Description of Artificial Sequence: Synthetic polypeptide
  XENP018535 1G6_H1.39_L1_scFv(GKPGS)4
EVQLVESGGGLVKPGGSLRLSCAASGFTFSNYYMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6705 - protein, 122 aa, Artificial Sequence
  Description of Artificial Sequence: Synthetic polypeptide
  VH of XENP018535
EVQLVESGGGLVKPGGSLRLSCAASGFTFSNYYMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6706 - protein, 107 aa, Artificial Sequence; identical to SEQ ID NO: 6247
  Description of Artificial Sequence: Synthetic polypeptide
  VL of XENP018535

SEQ ID NO: 6707 - protein, 5 aa, Artificial Sequence
  Description of Artificial Sequence: Synthetic peptide
  XENP018535 vhCDR1
NYYMN

SEQ ID NO: 6708 - protein, 19 aa, Artificial Sequence
  Description of Artificial Sequence: Synthetic peptide
  XENP018535 vhCDR2
EIRLKSNNYATHYAEPVKG

SEQ ID NO: 6709 - protein, 11 aa, Artificial Sequence
  Description of Artificial Sequence: Synthetic peptide
  XENP018535 vhCDR3
YYGNYGGYFDV

SEQ ID NO: 6710 - protein, 11 aa, Artificial Sequence
  Description of Artificial Sequence: Synthetic peptide
  XENP018535 vlCDR1
RASQSVSNDVA

SEQ ID NO: 6711 - protein, 7 aa, Artificial Sequence
  Description of Artificial Sequence: Synthetic peptide
  XENP018535 vlCDR2
YASHRYT

SEQ ID NO: 6712 - protein, 9 aa, Artificial Sequence
  Description of Artificial Sequence: Synthetic peptide
  XENP018535 vlCDR3
QQDYSSPRT

SEQ ID NO: 6713 - protein, 249 aa, Artificial Sequence
  Description of Artificial Sequence: Synthetic polypeptide
  XENP018536 1G6_H1.40_L1_scFv(GKPGS)4
EVQLVESGGGLVKPGGSLRLSCAASGFTFSNYDMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6714 - protein, 122 aa, Artificial Sequence
  Description of Artificial Sequence: Synthetic polypeptide
  VH of XENP018536
EVQLVESGGGLVKPGGSLRLSCAASGFTFSNYDMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6715 - protein, 107 aa, Artificial Sequence; identical to SEQ ID NO: 6247
  Description of Artificial Sequence: Synthetic polypeptide
  VL of XENP018536

SEQ ID NO: 6716 - protein, 5 aa, Artificial Sequence
  Description of Artificial Sequence: Synthetic peptide
  XENP018536 vhCDR1
NYDMN

SEQ ID NO: 6717 - protein, 19 aa, Artificial Sequence
  Description of Artificial Sequence: Synthetic peptide
  XENP018536 vhCDR2
EIRLKSNNYATHYAEPVKG

SEQ ID NO: 6718 - protein, 11 aa, Artificial Sequence
  Description of Artificial Sequence: Synthetic peptide
  XENP018536 vhCDR3
YYGNYGGYFDV

SEQ ID NO: 6719 - protein, 11 aa, Artificial Sequence
  Description of Artificial Sequence: Synthetic peptide
  XENP018536 vlCDR1
RASQSVSNDVA

SEQ ID NO: 6720 - protein, 7 aa, Artificial Sequence
  Description of Artificial Sequence: Synthetic peptide
  XENP018536 vlCDR2
YASHRYT

SEQ ID NO: 6721 - protein, 9 aa, Artificial Sequence
  Description of Artificial Sequence: Synthetic peptide
  XENP018536 vlCDR3
QQDYSSPRT

SEQ ID NO: 6722 - protein, 249 aa, Artificial Sequence
  Description of Artificial Sequence: Synthetic polypeptide
  XENP018537 1G6_H1.41_L1_scFv(GKPGS)4
EVQLVESGGGLVKPGGSLRLSCAASGFTFSNYWMSWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6723 - protein, 122 aa, Artificial Sequence
  Description of Artificial Sequence: Synthetic polypeptide
  VH of XENP018537
EVQLVESGGGLVKPGGSLRLSCAASGFTFSNYWMSWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6724 - protein, 107 aa, Artificial Sequence; identical to SEQ ID NO: 6247
  Description of Artificial Sequence: Synthetic polypeptide
  VL of XENP018537

SEQ ID NO: 6725 - protein, 5 aa, Artificial Sequence
  Description of Artificial Sequence: Synthetic peptide
  XENP018537 vhCDR1
NYWMS

SEQ ID NO: 6726 - protein, 19 aa, Artificial Sequence
  Description of Artificial Sequence: Synthetic peptide
  XENP018537 vhCDR2
EIRLKSNNYATHYAEPVKG

SEQ ID NO: 6727 - protein, 11 aa, Artificial Sequence
  Description of Artificial Sequence: Synthetic peptide
  XENP018537 vhCDR3
YYGNYGGYFDV

SEQ ID NO: 6728 - protein, 11 aa, Artificial Sequence
  Description of Artificial Sequence: Synthetic peptide
  XENP018537 vlCDR1
RASQSVSNDVA

SEQ ID NO: 6729 - protein, 7 aa, Artificial Sequence
  Description of Artificial Sequence: Synthetic peptide
  XENP018537 vlCDR2
YASHRYT

SEQ ID NO: 6730 - protein, 9 aa, Artificial Sequence
  Description of Artificial Sequence: Synthetic peptide
  XENP018537 vlCDR3
QQDYSSPRT

SEQ ID NO: 6731 - protein, 249 aa, Artificial Sequence
  Description of Artificial Sequence: Synthetic polypeptide
  XENP018538 1G6_H1.42_L1_scFv(GKPGS)4
EVQLVESGGGLVKPGGSLRLSCAASGFTFSNYWMHWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6732 - protein, 122 aa, Artificial Sequence
  Description of Artificial Sequence: Synthetic polypeptide
  VH of XENP018538
EVQLVESGGGLVKPGGSLRLSCAASGFTFSNYWMHWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6733 - protein, 107 aa, Artificial Sequence; identical to SEQ ID NO: 6247
  Description of Artificial Sequence: Synthetic polypeptide
  VL of XENP018538

SEQ ID NO: 6734 - protein, 5 aa, Artificial Sequence
  Description of Artificial Sequence: Synthetic peptide
  XENP018538 vhCDR1
NYWMH

SEQ ID NO: 6735 - protein, 19 aa, Artificial Sequence
  Description of Artificial Sequence: Synthetic peptide
  XENP018538 vhCDR2
EIRLKSNNYATHYAEPVKG

SEQ ID NO: 6736 - protein, 11 aa, Artificial Sequence
  Description of Artificial Sequence: Synthetic peptide
  XENP018538 vhCDR3
YYGNYGGYFDV

SEQ ID NO: 6737 - protein, 11 aa, Artificial Sequence
  Description of Artificial Sequence: Synthetic peptide
  XENP018538 vlCDR1
RASQSVSNDVA

SEQ ID NO: 6738 - protein, 7 aa, Artificial Sequence
  Description of Artificial Sequence: Synthetic peptide
  XENP018538 vlCDR2
YASHRYT

SEQ ID NO: 6739 - protein, 9 aa, Artificial Sequence
  Description of Artificial Sequence: Synthetic peptide
  XENP018538 vlCDR3
QQDYSSPRT

SEQ ID NO: 6740 - protein, 249 aa, Artificial Sequence
  Description of Artificial Sequence: Synthetic polypeptide
  XENP018539 1G6_H1.43_L1_scFv(GKPGS)4
EVQLVESGGGLVKPGGSLRLSCAASGFTFSNYWMDWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6741 - protein, 122 aa, Artificial Sequence
  Description of Artificial Sequence: Synthetic polypeptide
  VH of XENP018539
EVQLVESGGGLVKPGGSLRLSCAASGFTFSNYWMDWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6742 - protein, 107 aa, Artificial Sequence; identical to SEQ ID NO: 6247
  Description of Artificial Sequence: Synthetic polypeptide
  VL of XENP018539

SEQ ID NO: 6743 - protein, 5 aa, Artificial Sequence
  Description of Artificial Sequence: Synthetic peptide
  XENP018539 vhCDR1
NYWMD

SEQ ID NO: 6744 - protein, 19 aa, Artificial Sequence
  Description of Artificial Sequence: Synthetic peptide
  XENP018539 vhCDR2
EIRLKSNNYATHYAEPVKG

SEQ ID NO: 6745 - protein, 11 aa, Artificial Sequence
  Description of Artificial Sequence: Synthetic peptide
  XENP018539 vhCDR3
YYGNYGGYFDV

SEQ ID NO: 6746 - protein, 11 aa, Artificial Sequence
  Description of Artificial Sequence: Synthetic peptide
  XENP018539 vlCDR1
RASQSVSNDVA

SEQ ID NO: 6747 - protein, 7 aa, Artificial Sequence
  Description of Artificial Sequence: Synthetic peptide
  XENP018539 vlCDR2
YASHRYT

SEQ ID NO: 6748 - protein, 9 aa, Artificial Sequence
  Description of Artificial Sequence: Synthetic peptide
  XENP018539 vlCDR3
QQDYSSPRT

SEQ ID NO: 6749 - protein, 249 aa, Artificial Sequence
  Description of Artificial Sequence: Synthetic polypeptide
  XENP018540 1G6_H1.44_L1_scFv(GKPGS)4
EVQLVESGGGLVKPGGSLRLSCAASGFTFSNYWMGWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6750 - protein, 122 aa, Artificial Sequence
  Description of Artificial Sequence: Synthetic polypeptide
  VH of XENP018540
EVQLVESGGGLVKPGGSLRLSCAASGFTFSNYWMGWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6751 - protein, 107 aa, Artificial Sequence; identical to SEQ ID NO: 6247
  Description of Artificial Sequence: Synthetic polypeptide
  VL of XENP018540

SEQ ID NO: 6752 - protein, 5 aa, Artificial Sequence
  Description of Artificial Sequence: Synthetic peptide
  XENP018540 vhCDR1
NYWMG

SEQ ID NO: 6753 - protein, 19 aa, Artificial Sequence
  Description of Artificial Sequence: Synthetic peptide
  XENP018540 vhCDR2
EIRLKSNNYATHYAEPVKG

SEQ ID NO: 6754 - protein, 11 aa, Artificial Sequence
  Description of Artificial Sequence: Synthetic peptide
  XENP018540 vhCDR3
YYGNYGGYFDV

SEQ ID NO: 6755 - protein, 11 aa, Artificial Sequence
  Description of Artificial Sequence: Synthetic peptide
  XENP018540 vlCDR1
RASQSVSNDVA

SEQ ID NO: 6756 - protein, 7 aa, Artificial Sequence
  Description of Artificial Sequence: Synthetic peptide
  XENP018540 vlCDR2
YASHRYT

SEQ ID NO: 6757 - protein, 9 aa, Artificial Sequence
  Description of Artificial Sequence: Synthetic peptide
  XENP018540 vlCDR3
QQDYSSPRT

SEQ ID NO: 6758 - protein, 249 aa, Artificial Sequence
  Description of Artificial Sequence: Synthetic polypeptide
  XENP018541 1G6_H1.45_L1_scFv(GKPGS)4
EVQLVESGGGLVKPGGSLRLSCAASGFTFSNYWMNWARQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6759 - protein, 122 aa, Artificial Sequence
  Description of Artificial Sequence: Synthetic polypeptide
  VH of XENP018541
EVQLVESGGGLVKPGGSLRLSCAASGFTFSNYWMNWARQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6760 - protein, 107 aa, Artificial Sequence; identical to SEQ ID NO: 6247
  Description of Artificial Sequence: Synthetic polypeptide
  VL of XENP018541

SEQ ID NO: 6761 - protein, 5 aa, Artificial Sequence
  Description of Artificial Sequence: Synthetic peptide
  XENP018541 vhCDR1
NYWMN

SEQ ID NO: 6762 - protein, 19 aa, Artificial Sequence
  Description of Artificial Sequence: Synthetic peptide
  XENP018541 vhCDR2
EIRLKSNNYATHYAEPVKG

SEQ ID NO: 6763 - protein, 11 aa, Artificial Sequence
  Description of Artificial Sequence: Synthetic peptide
  XENP018541 vhCDR3
YYGNYGGYFDV

SEQ ID NO: 6764 - protein, 11 aa, Artificial Sequence
  Description of Artificial Sequence: Synthetic peptide
  XENP018541 vlCDR1
RASQSVSNDVA

SEQ ID NO: 6765 - protein, 7 aa, Artificial Sequence
  Description of Artificial Sequence: Synthetic peptide
  XENP018541 vlCDR2
YASHRYT

SEQ ID NO: 6766 - protein, 9 aa, Artificial Sequence
  Description of Artificial Sequence: Synthetic peptide
  XENP018541 vlCDR3
QQDYSSPRT

SEQ ID NO: 6767 - protein, 249 aa, Artificial Sequence
  Description of Artificial Sequence: Synthetic polypeptide
  XENP018542 1G6_H1.46_L1_scFv(GKPGS)4
EVQLVESGGGLVKPGGSLRLSCAASGFTFSNYWMNWIRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6768 - protein, 122 aa, Artificial Sequence
  Description of Artificial Sequence: Synthetic polypeptide
  VH of XENP018542
EVQLVESGGGLVKPGGSLRLSCAASGFTFSNYWMNWIRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6769 - protein, 107 aa, Artificial Sequence; identical to SEQ ID NO: 6247
  Description of Artificial Sequence: Synthetic polypeptide
  VL of XENP018542

SEQ ID NO: 6770 - protein, 5 aa, Artificial Sequence
  Description of Artificial Sequence: Synthetic peptide
  XENP018542 vhCDR1
NYWMN

SEQ ID NO: 6771 - protein, 19 aa, Artificial Sequence
  Description of Artificial Sequence: Synthetic peptide
  XENP018542 vhCDR2
EIRLKSNNYATHYAEPVKG

SEQ ID NO: 6772 - protein, 11 aa, Artificial Sequence
  Description of Artificial Sequence: Synthetic peptide
  XENP018542 vhCDR3
YYGNYGGYFDV

SEQ ID NO: 6773 - protein, 11 aa, Artificial Sequence
  Description of Artificial Sequence: Synthetic peptide
  XENP018542 vlCDR1
RASQSVSNDVA

SEQ ID NO: 6774 - protein, 7 aa, Artificial Sequence
  Description of Artificial Sequence: Synthetic peptide
  XENP018542 vlCDR2
YASHRYT

SEQ ID NO: 6775 - protein, 9 aa, Artificial Sequence
  Description of Artificial Sequence: Synthetic peptide
  XENP018542 vlCDR3
QQDYSSPRT

SEQ ID NO: 6776 - protein, 249 aa, Artificial Sequence
  Description of Artificial Sequence: Synthetic polypeptide
  XENP018543 1G6_H1.47_L1_scFv(GKPGS)4
EVQLVESGGGLVKPGGSLRLSCAASGFTFSNYWMNWFRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6777 - protein, 122 aa, Artificial Sequence
  Description of Artificial Sequence: Synthetic polypeptide
  VH of XENP018543
EVQLVESGGGLVKPGGSLRLSCAASGFTFSNYWMNWFRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6778 - protein, 107 aa, Artificial Sequence; identical to SEQ ID NO: 6247
  Description of Artificial Sequence: Synthetic polypeptide
  VL of XENP018543

SEQ ID NO: 6779 - protein, 5 aa, Artificial Sequence
  Description of Artificial Sequence: Synthetic peptide
  XENP018543 vhCDR1
NYWMN

SEQ ID NO: 6780 - protein, 19 aa, Artificial Sequence
  Description of Artificial Sequence: Synthetic peptide
  XENP018543 vhCDR2
EIRLKSNNYATHYAEPVKG

SEQ ID NO: 6781 - protein, 11 aa, Artificial Sequence
  Description of Artificial Sequence: Synthetic peptide
  XENP018543 vhCDR3
YYGNYGGYFDV

SEQ ID NO: 6782 - protein, 11 aa, Artificial Sequence
  Description of Artificial Sequence: Synthetic peptide
  XENP018543 vlCDR1
RASQSVSNDVA

SEQ ID NO: 6783 - protein, 7 aa, Artificial Sequence
  Description of Artificial Sequence: Synthetic peptide
  XENP018543 vlCDR2
YASHRYT

SEQ ID NO: 6784 - protein, 9 aa, Artificial Sequence
  Description of Artificial Sequence: Synthetic peptide
  XENP018543 vlCDR3
QQDYSSPRT

SEQ ID NO: 6785 - protein, 249 aa, Artificial Sequence
  Description of Artificial Sequence: Synthetic polypeptide
  XENP018544 1G6_H1.48_L1_scFv(GKPGS)4
EVQLVESGGGLVKPGGSLRLSCAASGFTFSNYWMNWVRKAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6786 - protein, 122 aa, Artificial Sequence
  Description of Artificial Sequence: Synthetic polypeptide
  VH of XENP018544
EVQLVESGGGLVKPGGSLRLSCAASGFTFSNYWMNWVRKAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6787 - protein, 107 aa, Artificial Sequence; identical to SEQ ID NO: 6247
  Description of Artificial Sequence: Synthetic polypeptide
  VL of XENP018544

SEQ ID NO: 6788 - protein, 11 aa, Artificial Sequence
  Description of Artificial Sequence: Synthetic peptide
  XENP018544 vlCDR1
RASQSVSNDVA

SEQ ID NO: 6789 - protein, 7 aa, Artificial Sequence
  Description of Artificial Sequence: Synthetic peptide
  XENP018544 vlCDR2
YASHRYT

SEQ ID NO: 6790 - protein, 9 aa, Artificial Sequence
  Description of Artificial Sequence: Synthetic peptide
  XENP018544 vlCDR3
QQDYSSPRT

SEQ ID NO: 6791 - protein, 249 aa, Artificial Sequence
  Description of Artificial Sequence: Synthetic polypeptide
  XENP018545 1G6_H1.49_L1_scFv(GKPGS)4
EVQLVESGGGLVKPGGSLRLSCAASGFTFSNYWMNWVRQSPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6792 - protein, 122 aa, Artificial Sequence
  Description of Artificial Sequence: Synthetic polypeptide
  VH of XENP018545
EVQLVESGGGLVKPGGSLRLSCAASGFTFSNYWMNWVRQSPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6793 - protein, 107 aa, Artificial Sequence; identical to SEQ ID NO: 6247
  Description of Artificial Sequence: Synthetic polypeptide
  VL of XENP018545

SEQ ID NO: 6794 - protein, 5 aa, Artificial Sequence
  Description of Artificial Sequence: Synthetic peptide
  XENP018545 vhCDR1
NYWMN

SEQ ID NO: 6795 - protein, 19 aa, Artificial Sequence
  Description of Artificial Sequence: Synthetic peptide
  XENP018545 vhCDR2
EIRLKSNNYATHYAEPVKG

SEQ ID NO: 6796 - protein, 11 aa, Artificial Sequence
  Description of Artificial Sequence: Synthetic peptide
  XENP018545 vhCDR3
YYGNYGGYFDV

SEQ ID NO: 6797 - protein, 11 aa, Artificial Sequence
  Description of Artificial Sequence: Synthetic peptide
  XENP018545 vlCDR1
RASQSVSNDVA

SEQ ID NO: 6798 - protein, 7 aa, Artificial Sequence
  Description of Artificial Sequence: Synthetic peptide
  XENP018545 vlCDR2
YASHRYT

SEQ ID NO: 6799 - protein, 9 aa, Artificial Sequence
  Description of Artificial Sequence: Synthetic peptide
  XENP018545 vlCDR3
QQDYSSPRT

SEQ ID NO: 6800 - protein, 249 aa, Artificial Sequence
  Description of Artificial Sequence: Synthetic polypeptide
  XENP018546 1G6_H1.50_L1_scFv(GKPGS)4
EVQLVESGGGLVKPGGSLRLSCAASGFTFSNYWMNWVRQAPEKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6801 - protein, 122 aa, Artificial Sequence
  Description of Artificial Sequence: Synthetic polypeptide
  VH of XENP018546
EVQLVESGGGLVKPGGSLRLSCAASGFTFSNYWMNWVRQAPEKGLEWVGEIRLKSNNYATHYAEPVKGRFTISRDDSKSTVYLQMNSLKTEDTAVYYCTRYYGNYGGYFDVWGAGTLVTVSS

SEQ ID NO: 6802 - protein, 107 aa, Artificial Sequence; identical to SEQ ID NO: 6247
  Description of Artificial Sequence: Synthetic polypeptide
  VL of XENP018546

SEQ ID NO: 6803 - protein, 5 aa, Artificial Sequence
  Description of Artificial Sequence: Synthetic peptide
  XENP018546 vhCDR1
NYWMN

SEQ ID NO: 6804 - protein, 19 aa, Artificial Sequence
  Description of Artificial Sequence: Synthetic peptide
  XENP018546 vhCDR2
EIRLKSNNYATHYAEPVKG

SEQ ID NO: 6805 - protein, 11 aa, Artificial Sequence
  Description of Artificial Sequence: Synthetic peptide
  XENP018546 vhCDR3
YYGNYGGYFDV

SEQ ID NO: 6806 - protein, 11 aa, Artificial Sequence
  Description of Artificial Sequence: Synthetic peptide
  XENP018546 vlCDR1
RASQSVSNDVA

SEQ ID NO: 6807 - protein, 7 aa, Artificial Sequence
  Description of Artificial Sequence: Synthetic peptide
  XENP018546 vlCDR2
YASHRYT

SEQ ID NO: 6808 - protein, 9 aa, Artificial Sequence
  Description of Artificial Sequence: Synthetic peptide
  XENP018546 vlCDR3
QQDYSSPRT

SEQ ID NO: 6809 - protein, 249 aa, Artificial Sequence
  Description of Artificial Sequence: Synthetic polypeptide
  XENP018547 1G6_H1.51_L1_scFv(GKPGS)4
EVQLVESGGGLVKPGGSLRLSCAASGFTFSNYWMNWVRQAPGKGLEYVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6810 - protein, 122 aa, Artificial Sequence
  Description of Artificial Sequence: Synthetic polypeptide
  VH of XENP018547
EVQLVESGGGLVKPGGSLRLSCAASGFTFSNYWMNWVRQAPGKGLEYVGEIRLKSNNYATHYAEPVKGRFTISRDDSKSTVYLQMNSLKTEDTAVYYCTRYYGNYGGYFDVWGAGTLVTVSS

SEQ ID NO: 6811 - protein, 107 aa, Artificial Sequence; identical to SEQ ID NO: 6247
  Description of Artificial Sequence: Synthetic polypeptide
  VL of XENP018547

SEQ ID NO: 6812 - protein, 5 aa, Artificial Sequence
  Description of Artificial Sequence: Synthetic peptide
  XENP018547 vhCDR1
NYWMN

SEQ ID NO: 6813 - protein, 19 aa, Artificial Sequence
  Description of Artificial Sequence: Synthetic peptide
  XENP018547 vhCDR2
EIRLKSNNYATHYAEPVKG

SEQ ID NO: 6814 - protein, 11 aa, Artificial Sequence
  Description of Artificial Sequence: Synthetic peptide
  XENP018547 vhCDR3
YYGNYGGYFDV

SEQ ID NO: 6815 - protein, 11 aa, Artificial Sequence
  Description of Artificial Sequence: Synthetic peptide
  XENP018547 vlCDR1
RASQSVSNDVA

SEQ ID NO: 6816 - protein, 7 aa, Artificial Sequence
  Description of Artificial Sequence: Synthetic peptide
  XENP018547 vlCDR2
YASHRYT

SEQ ID NO: 6817 - protein, 9 aa, Artificial Sequence
  Description of Artificial Sequence: Synthetic peptide
  XENP018547 vlCDR3
QQDYSSPRT

SEQ ID NO: 6818 - protein, 249 aa, Artificial Sequence
  Description of Artificial Sequence: Synthetic polypeptide
  XENP018548 1G6_H1.52_L1_scFv(GKPGS)4
EVQLVESGGGLVKPGGSLRLSCAASGFTFSNYWMNWVRQAPGKGLEWVAEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6819 - protein, 122 aa, Artificial Sequence
  Description of Artificial Sequence: Synthetic polypeptide
  VH of XENP018548
EVQLVESGGGLVKPGGSLRLSCAASGFTFSNYWMNWVRQAPGKGLEWVAEIRLKSNNYATHYAEPVKGRFTISRDDSKSTVYLQMNSLKTEDTAVYYCTRYYGNYGGYFDVWGAGTLVTVSS

SEQ ID NO: 6820 - protein, 107 aa, Artificial Sequence; identical to SEQ ID NO: 6247
  Description of Artificial Sequence: Synthetic polypeptide
  VL of XENP018548

SEQ ID NO: 6821 - protein, 5 aa, Artificial Sequence
  Description of Artificial Sequence: Synthetic peptide
  XENP018548 vhCDR1
NYWMN

SEQ ID NO: 6822 - protein, 19 aa, Artificial Sequence
  Description of Artificial Sequence: Synthetic peptide
  XENP018548 vhCDR2
EIRLKSNNYATHYAEPVKG

SEQ ID NO: 6823 - protein, 11 aa, Artificial Sequence
  Description of Artificial Sequence: Synthetic peptide
  XENP018548 vhCDR3
YYGNYGGYFDV

SEQ ID NO: 6824 - protein, 11 aa, Artificial Sequence
  Description of Artificial Sequence: Synthetic peptide
  XENP018548 vlCDR1
RASQSVSNDVA

SEQ ID NO: 6825 - protein, 7 aa, Artificial Sequence
  Description of Artificial Sequence: Synthetic peptide
  XENP018548 vlCDR2
YASHRYT

SEQ ID NO: 6826 - protein, 9 aa, Artificial Sequence
  Description of Artificial Sequence: Synthetic peptide
  XENP018548 vlCDR3
QQDYSSPRT

SEQ ID NO: 6827 - protein, 249 aa, Artificial Sequence
  Description of Artificial Sequence: Synthetic polypeptide
  XENP018549 1G6_H1.53_L1_scFv(GKPGS)4
EVQLVESGGGLVKPGGSLRLSCAASGFTFSNYWMNWVRQAPGKGLEWVSEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6828 - protein, 122 aa, Artificial Sequence
  Description of Artificial Sequence: Synthetic polypeptide
  VH of XENP018549
EVQLVESGGGLVKPGGSLRLSCAASGFTFSNYWMNWVRQAPGKGLEWVSEIRLKSNNYATHYAEPVKGRFTISRDDSKSTVYLQMNSLKTEDTAVYYCTRYYGNYGGYFDVWGAGTLVTVSS

SEQ ID NO: 6829 - protein, 107 aa, Artificial Sequence; identical to SEQ ID NO: 6247
  Description of Artificial Sequence: Synthetic polypeptide
  VL of XENP018549

SEQ ID NO: 6830 - protein, 5 aa, Artificial Sequence
  Description of Artificial Sequence: Synthetic peptide
  XENP018549 vhCDR1
NYWMN

SEQ ID NO: 6831 - protein, 19 aa, Artificial Sequence
  Description of Artificial Sequence: Synthetic peptide
  XENP018549 vhCDR2
EIRLKSNNYATHYAEPVKG

SEQ ID NO: 6832 - protein, 11 aa, Artificial Sequence
  Description of Artificial Sequence: Synthetic peptide
  XENP018549 vhCDR3
YYGNYGGYFDV

SEQ ID NO: 6833 - protein, 11 aa, Artificial Sequence
  Description of Artificial Sequence: Synthetic peptide
  XENP018549 vlCDR1
RASQSVSNDVA

SEQ ID NO: 6834 - protein, 7 aa, Artificial Sequence
  Description of Artificial Sequence: Synthetic peptide
  XENP018549 vlCDR2
YASHRYT

SEQ ID NO: 6835 - protein, 9 aa, Artificial Sequence
  Description of Artificial Sequence: Synthetic peptide
  XENP018549 vlCDR3
QQDYSSPRT

SEQ ID NO: 6836 - protein, 249 aa, Artificial Sequence
  Description of Artificial Sequence: Synthetic polypeptide
  XENP018550 1G6_H1.54_L1_scFv(GKPGS)4
EVQLVESGGGLVKPGGSLRLSCAASGFTFSNYWMNWVRQAPGKGLEWVGQIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6837 - protein, 122 aa, Artificial Sequence
  Description of Artificial Sequence: Synthetic polypeptide
  VH of XENP018550
EVQLVESGGGLVKPGGSLRLSCAASGFTFSNYWMNWVRQAPGKGLEWVGQIRLKSNNYATHYAEPVKGRFTISRDDSKSTVYLQMNSLKTEDTAVYYCTRYYGNYGGYFDVWGAGTLVTVSS

SEQ ID NO: 6838 - protein, 107 aa, Artificial Sequence; identical to SEQ ID NO: 6247
  Description of Artificial Sequence: Synthetic polypeptide
  VL of XENP018550

SEQ ID NO: 6839 - protein, 5 aa, Artificial Sequence
  Description of Artificial Sequence: Synthetic peptide
  XENP018550 vhCDR1
NYWMN

SEQ ID NO: 6840 - protein, 19 aa, Artificial Sequence
  Description of Artificial Sequence: Synthetic peptide
  XENP018550 vhCDR2
QIRLKSNNYATHYAEPVKG

SEQ ID NO: 6841 - protein, 11 aa, Artificial Sequence
  Description of Artificial Sequence: Synthetic peptide
  XENP018550 vhCDR3
YYGNYGGYFDV

SEQ ID NO: 6842 - protein, 11 aa, Artificial Sequence
  Description of Artificial Sequence: Synthetic peptide
  XENP018550 vlCDR1
RASQSVSNDVA

SEQ ID NO: 6843 - protein, 7 aa, Artificial Sequence
  Description of Artificial Sequence: Synthetic peptide
  XENP018550 vlCDR2
YASHRYT

SEQ ID NO: 6844 - protein, 9 aa, Artificial Sequence
  Description of Artificial Sequence: Synthetic peptide
  XENP018550 vlCDR3
QQDYSSPRT

SEQ ID NO: 6845 - protein, 249 aa, Artificial Sequence
  Description of Artificial Sequence: Synthetic polypeptide
  XENP018551 1G6_H1.55_L1_scFv(GKPGS)4
EVQLVESGGGLVKPGGSLRLSCAASGFTFSNYWMNWVRQAPGKGLEWVGDIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6846 - protein, 122 aa, Artificial Sequence
  Description of Artificial Sequence: Synthetic polypeptide
  VH of XENP018551
EVQLVESGGGLVKPGGSLRLSCAASGFTFSNYWMNWVRQAPGKGLEWVGDIRLKSNNYATHYAEPVKGRFTISRDDSKSTVYLQMNSLKTEDTAVYYCTRYYGNYGGYFDVWGAGTLVTVSS

SEQ ID NO: 6847 - protein, 107 aa, Artificial Sequence; identical to SEQ ID NO: 6247
  Description of Artificial Sequence: Synthetic polypeptide
  VL of XENP018551

SEQ ID NO: 6848 - protein, 5 aa, Artificial Sequence
  Description of Artificial Sequence: Synthetic peptide
  XENP018551 vhCDR1
NYWMN

SEQ ID NO: 6849 - protein, 19 aa, Artificial Sequence
  Description of Artificial Sequence: Synthetic peptide
  XENP018551 vhCDR2
DIRLKSNNYATHYAEPVKG

SEQ ID NO: 6850 - protein, 11 aa, Artificial Sequence
  Description of Artificial Sequence: Synthetic peptide
  XENP018551 vhCDR3
YYGNYGGYFDV

SEQ ID NO: 6851 - protein, 11 aa, Artificial Sequence
  Description of Artificial Sequence: Synthetic peptide
  XENP018551 vlCDR1
RASQSVSNDVA

SEQ ID NO: 6852 - protein, 7 aa, Artificial Sequence
  Description of Artificial Sequence: Synthetic peptide
  XENP018551 vlCDR2
YASHRYT

SEQ ID NO: 6853 - protein, 9 aa, Artificial Sequence
  Description of Artificial Sequence: Synthetic peptide
  XENP018551 vlCDR3
QQDYSSPRT

SEQ ID NO: 6854 - protein, 249 aa, Artificial Sequence
  Description of Artificial Sequence: Synthetic polypeptide
  XENP018552 1G6_H1.56_L1_scFv(GKPGS)4
EVQLVESGGGLVKPGGSLRLSCAASGFTFSNYWMNWVRQAPGKGLEWVGKIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6855 - protein, 122 aa, Artificial Sequence
  Description of Artificial Sequence: Synthetic polypeptide
  VH of XENP018552
EVQLVESGGGLVKPGGSLRLSCAASGFTFSNYWMNWVRQAPGKGLEWVGKIRLKSNNYATHYAEPVKGRFTISRDDSKSTVYLQMNSLKTEDTAVYYCTRYYGNYGGYFDVWGAGTLVTVSS

SEQ ID NO: 6856 - protein, 107 aa, Artificial Sequence; identical to SEQ ID NO: 6247
  Description of Artificial Sequence: Synthetic polypeptide
  VL of XENP018552

SEQ ID NO: 6857 - protein, 5 aa, Artificial Sequence
  Description of Artificial Sequence: Synthetic peptide
  XENP018552 vhCDR1
NYWMN

SEQ ID NO: 6858 - protein, 19 aa, Artificial Sequence
  Description of Artificial Sequence: Synthetic peptide
  XENP018552 vhCDR2
KIRLKSNNYATHYAEPVKG

SEQ ID NO: 6859 - protein, 11 aa, Artificial Sequence
  Description of Artificial Sequence: Synthetic peptide
  XENP018552 vhCDR3
YYGNYGGYFDV

SEQ ID NO: 6860 - protein, 11 aa, Artificial Sequence
  Description of Artificial Sequence: Synthetic peptide
  XENP018552 vlCDR1
RASQSVSNDVA

SEQ ID NO: 6861 - protein, 7 aa, Artificial Sequence
  Description of Artificial Sequence: Synthetic peptide
  XENP018552 vlCDR2
YASHRYT

SEQ ID NO: 6862 - protein, 9 aa, Artificial Sequence
  Description of Artificial Sequence: Synthetic peptide
  XENP018552 vlCDR3
QQDYSSPRT

SEQ ID NO: 6863 - protein, 249 aa, Artificial Sequence
  Description of Artificial Sequence: Synthetic polypeptide
  XENP018553 1G6_H1.57_L1_scFv(GKPGS)4
EVQLVESGGGLVKPGGSLRLSCAASGFTFSNYWMNWVRQAPGKGLEWVGSIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6864 - protein, 122 aa, Artificial Sequence
  Description of Artificial Sequence: Synthetic polypeptide
  VH of XENP018553
EVQLVESGGGLVKPGGSLRLSCAASGFTFSNYWMNWVRQAPGKGLEWVGSIRLKSNNYATHYAEPVKGRFTISRDDSKSTVYLQMNSLKTEDTAVYYCTRYYGNYGGYFDVWGAGTLVTVSS

SEQ ID NO: 6865 - protein, 107 aa, Artificial Sequence; identical to SEQ ID NO: 6247
  Description of Artificial Sequence: Synthetic polypeptide
  VL of XENP018553

SEQ ID NO: 6866 - protein, 5 aa, Artificial Sequence
  Description of Artificial Sequence: Synthetic peptide
  XENP018553 vhCDR1
NYWMN

SEQ ID NO: 6867 - protein, 19 aa, Artificial Sequence
  Description of Artificial Sequence: Synthetic peptide
  XENP018553 vhCDR2
SIRLKSNNYATHYAEPVKG

SEQ ID NO: 6868 - protein, 11 aa, Artificial Sequence
  Description of Artificial Sequence: Synthetic peptide
  XENP018553 vhCDR3
YYGNYGGYFDV

SEQ ID NO: 6869 - protein, 11 aa, Artificial Sequence
  Description of Artificial Sequence: Synthetic peptide
  XENP018553 vlCDR1
RASQSVSNDVA

SEQ ID NO: 6870 - protein, 7 aa, Artificial Sequence
  Description of Artificial Sequence: Synthetic peptide
  XENP018553 vlCDR2
YASHRYT

SEQ ID NO: 6871 - protein, 9 aa, Artificial Sequence
  Description of Artificial Sequence: Synthetic peptide
  XENP018553 vlCDR3
QQDYSSPRT

SEQ ID NO: 6872 - protein, 249 aa, Artificial Sequence
  Description of Artificial Sequence: Synthetic polypeptide
  XENP018554 1G6_H1.58_L1_scFv(GKPGS)4
EVQLVESGGGLVKPGGSLRLSCAASGFTFSNYWMNWVRQAPGKGLEWVGHIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6873 - protein, 122 aa, Artificial Sequence
  Description of Artificial Sequence: Synthetic polypeptide
  VH of XENP018554
EVQLVESGGGLVKPGGSLRLSCAASGFTFSNYWMNWVRQAPGKGLEWVGHIRLKSNNYATHYAEPVKGRFTISRDDSKSTVYLQMNSLKTEDTAVYYCTRYYGNYGGYFDVWGAGTLVTVSS

SEQ ID NO: 6874 - protein, 107 aa, Artificial Sequence; identical to SEQ ID NO: 6247
  Description of Artificial Sequence: Synthetic polypeptide
  VL of XENP018554

SEQ ID NO: 6875 - protein, 5 aa, Artificial Sequence
  Description of Artificial Sequence: Synthetic peptide
  XENP018554 vhCDR1
NYWMN

SEQ ID NO: 6876 - protein, 19 aa, Artificial Sequence
  Description of Artificial Sequence: Synthetic peptide
  XENP018554 vhCDR2
HIRLKSNNYATHYAEPVKG

SEQ ID NO: 6877 - protein, 11 aa, Artificial Sequence
  Description of Artificial Sequence: Synthetic peptide
  XENP018554 vhCDR3
YYGNYGGYFDV

SEQ ID NO: 6878 - protein, 11 aa, Artificial Sequence
  Description of Artificial Sequence: Synthetic peptide
  XENP018554 vlCDR1
RASQSVSNDVA

SEQ ID NO: 6879 - protein, 7 aa, Artificial Sequence
  Description of Artificial Sequence: Synthetic peptide
  XENP018554 vlCDR2
YASHRYT

SEQ ID NO: 6880 - protein, 9 aa, Artificial Sequence
  Description of Artificial Sequence: Synthetic peptide
  XENP018554 vlCDR3
QQDYSSPRT

SEQ ID NO: 6881 - protein, 249 aa, Artificial Sequence
  Description of Artificial Sequence: Synthetic polypeptide
  XENP018555 1G6_H1.59_L1_scFv(GKPGS)4
EVQLVESGGGLVKPGGSLRLSCAASGFTFSNYWMNWVRQAPGKGLEWVGAIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6882 - protein, 122 aa, Artificial Sequence
  Description of Artificial Sequence: Synthetic polypeptide
  VH of XENP018555
EVQLVESGGGLVKPGGSLRLSCAASGFTFSNYWMNWVRQAPGKGLEWVGAIRLKSNNYATHYAEPVKGRFTISRDDSKSTVYLQMNSLKTEDTAVYYCTRYYGNYGGYFDVWGAGTLVTVSS

SEQ ID NO: 6883 - protein, 107 aa, Artificial Sequence; identical to SEQ ID NO: 6247
  Description of Artificial Sequence: Synthetic polypeptide
  VL of XENP018555

SEQ ID NO: 6884 - protein, 5 aa, Artificial Sequence
  Description of Artificial Sequence: Synthetic peptide
  XENP018555 vhCDR1
NYWMN

SEQ ID NO: 6885 - protein, 19 aa, Artificial Sequence
  Description of Artificial Sequence: Synthetic peptide
  XENP018555 vhCDR2
AIRLKSNNYATHYAEPVKG

SEQ ID NO: 6886 - protein, 11 aa, Artificial Sequence
  Description of Artificial Sequence: Synthetic peptide
  XENP018555 vhCDR3
YYGNYGGYFDV

SEQ ID NO: 6887 - protein, 11 aa, Artificial Sequence
  Description of Artificial Sequence: Synthetic peptide
  XENP018555 vlCDR1
RASQSVSNDVA

SEQ ID NO: 6888 - protein, 7 aa, Artificial Sequence
  Description of Artificial Sequence: Synthetic peptide
  XENP018555 vlCDR2
YASHRYT

SEQ ID NO: 6889 - protein, 9 aa, Artificial Sequence
  Description of Artificial Sequence: Synthetic peptide
  XENP018555 vlCDR3
QQDYSSPRT

SEQ ID NO: 6890 - protein, 249 aa, Artificial Sequence
  Description of Artificial Sequence: Synthetic polypeptide
  XENP018556 1G6_H1.60_L1_scFv(GKPGS)4
EVQLVESGGGLVKPGGSLRLSCAASGFTFSNYWMNWVRQAPGKGLEWVGGIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6891 - protein, 122 aa, Artificial Sequence
  Description of Artificial Sequence: Synthetic polypeptide
  VH of XENP018556
EVQLVESGGGLVKPGGSLRLSCAASGFTFSNYWMNWVRQAPGKGLEWVGGIRLKSNNYATHYAEPVKGRFTISRDDSKSTVYLQMNSLKTEDTAVYYCTRYYGNYGGYFDVWGAGTLVTVSS

SEQ ID NO: 6892 - protein, 107 aa, Artificial Sequence; identical to SEQ ID NO: 6247
  Description of Artificial Sequence: Synthetic polypeptide
  VL of XENP018556

SEQ ID NO: 6893 - protein, 5 aa, Artificial Sequence
  Description of Artificial Sequence: Synthetic peptide
  XENP018556 vhCDR1
NYWMN

SEQ ID NO: 6894 - protein, 19 aa, Artificial Sequence
  Description of Artificial Sequence: Synthetic peptide
  XENP018556 vhCDR2
GIRLKSNNYATHYAEPVKG

SEQ ID NO: 6895 - protein, 11 aa, Artificial Sequence
  Description of Artificial Sequence: Synthetic peptide
  XENP018556 vhCDR3
YYGNYGGYFDV

SEQ ID NO: 6896 - protein, 11 aa, Artificial Sequence
  Description of Artificial Sequence: Synthetic peptide
  XENP018556 vlCDR1
RASQSVSNDVA

SEQ ID NO: 6897 - protein, 7 aa, Artificial Sequence
  Description of Artificial Sequence: Synthetic peptide
  XENP018556 vlCDR2
YASHRYT

SEQ ID NO: 6898 - protein, 9 aa, Artificial Sequence
  Description of Artificial Sequence: Synthetic peptide
  XENP018556 vlCDR3
QQDYSSPRT

SEQ ID NO: 6899 - protein, 249 aa, Artificial Sequence
  Description of Artificial Sequence: Synthetic polypeptide
  XENP018557 1G6_H1.61_L1_scFv(GKPGS)4
EVQLVESGGGLVKPGGSLRLSCAASGFTFSNYWMNWVRQAPGKGLEWVGYIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6900 - protein, 122 aa, Artificial Sequence
  Description of Artificial Sequence: Synthetic polypeptide
  VH of XENP018557
EVQLVESGGGLVKPGGSLRLSCAASGFTFSNYWMNWVRQAPGKGLEWVGYIRLKSNNYATHYAEPVKGRFTISRDDSKSTVYLQMNSLKTEDTAVYYCTRYYGNYGGYFDVWGAGTLVTVSS

SEQ ID NO: 6901 - protein, 107 aa, Artificial Sequence; identical to SEQ ID NO: 6247
  Description of Artificial Sequence: Synthetic polypeptide
  VL of XENP018557

SEQ ID NO: 6902 - protein, 5 aa, Artificial Sequence
  Description of Artificial Sequence: Synthetic peptide
  XENP018557 vhCDR1
NYWMN

SEQ ID NO: 6903 - protein, 19 aa, Artificial Sequence
  Description of Artificial Sequence: Synthetic peptide
  XENP018557 vhCDR2
YIRLKSNNYATHYAEPVKG

SEQ ID NO: 6904 - protein, 11 aa, Artificial Sequence
  Description of Artificial Sequence: Synthetic peptide
  XENP018557 vhCDR3
YYGNYGGYFDV

SEQ ID NO: 6905 - protein, 11 aa, Artificial Sequence
  Description of Artificial Sequence: Synthetic peptide
  XENP018557 vlCDR1
RASQSVSNDVA

SEQ ID NO: 6906 - protein, 7 aa, Artificial Sequence
  Description of Artificial Sequence: Synthetic peptide
  XENP018557 vlCDR2
YASHRYT

SEQ ID NO: 6907 - protein, 9 aa, Artificial Sequence
  Description of Artificial Sequence: Synthetic peptide
  XENP018557 vlCDR3
QQDYSSPRT

SEQ ID NO: 6908 - protein, 249 aa, Artificial Sequence
  Description of Artificial Sequence: Synthetic polypeptide
  XENP018558 1G6_H1.62_L1_scFv(GKPGS)4
EVQLVESGGGLVKPGGSLRLSCAASGFTFSNYWMNWVRQAPGKGLEWVGIIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6909 - protein, 122 aa, Artificial Sequence
  Description of Artificial Sequence: Synthetic polypeptide
  VH of XENP018558
EVQLVESGGGLVKPGGSLRLSCAASGFTFSNYWMNWVRQAPGKGLEWVGIIRLKSNNYATHYAEPVKGRFTISRDDSKSTVYLQMNSLKTEDTAVYYCTRYYGNYGGYFDVWGAGTLVTVSS

SEQ ID NO: 6910 - protein, 107 aa, Artificial Sequence; identical to SEQ ID NO: 6247
  Description of Artificial Sequence: Synthetic polypeptide
  VL of XENP018558

SEQ ID NO: 6911 - protein, 5 aa, Artificial Sequence
  Description of Artificial Sequence: Synthetic peptide
  XENP018558 vhCDR1
NYWMN

SEQ ID NO: 6912 - protein, 19 aa, Artificial Sequence
  Description of Artificial Sequence: Synthetic peptide
  XENP018558 vhCDR2
IIRLKSNNYATHYAEPVKG

SEQ ID NO: 6913 - protein, 11 aa, Artificial Sequence
  Description of Artificial Sequence: Synthetic peptide
  XENP018558 vhCDR3
YYGNYGGYFDV

SEQ ID NO: 6914 - protein, 11 aa, Artificial Sequence
  Description of Artificial Sequence: Synthetic peptide
  XENP018558 vlCDR1
RASQSVSNDVA

SEQ ID NO: 6915 - protein, 7 aa, Artificial Sequence
  Description of Artificial Sequence: Synthetic peptide
  XENP018558 vlCDR2
YASHRYT

SEQ ID NO: 6916 - protein, 9 aa, Artificial Sequence
  Description of Artificial Sequence: Synthetic peptide
  XENP018558 vlCDR3
QQDYSSPRT

SEQ ID NO: 6917 - protein, 249 aa, Artificial Sequence
  Description of Artificial Sequence: Synthetic polypeptide
  XENP018559 1G6_H1.63_L1_scFv(GKPGS)4
EVQLVESGGGLVKPGGSLRLSCAASGFTFSNYWMNWVRQAPGKGLEWVGEVRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6918 - protein, 122 aa, Artificial Sequence
  Description of Artificial Sequence: Synthetic polypeptide
  VH of XENP018559
EVQLVESGGGLVKPGGSLRLSCAASGFTFSNYWMNWVRQAPGKGLEWVGEVRLKSNNYATHYAEPVKGRFTISRDDSKSTVYLQMNSLKTEDTAVYYCTRYYGNYGGYFDVWGAGTLVTVSS

SEQ ID NO: 6919 - protein, 107 aa, Artificial Sequence; identical to SEQ ID NO: 6247
  Description of Artificial Sequence: Synthetic polypeptide
  VL of XENP018559

SEQ ID NO: 6920 - protein, 5 aa, Artificial Sequence
  Description of Artificial Sequence: Synthetic peptide
  XENP018559 vhCDR1
NYWMN

SEQ ID NO: 6921 - protein, 19 aa, Artificial Sequence
  Description of Artificial Sequence: Synthetic peptide
  XENP018559 vhCDR2
EVRLKSNNYATHYAEPVKG

SEQ ID NO: 6922 - protein, 11 aa, Artificial Sequence
  Description of Artificial Sequence: Synthetic peptide
  XENP018559 vhCDR3
YYGNYGGYFDV

SEQ ID NO: 6923 - protein, 11 aa, Artificial Sequence
  Description of Artificial Sequence: Synthetic peptide
  XENP018559 vlCDR1
RASQSVSNDVA

SEQ ID NO: 6924 - protein, 7 aa, Artificial Sequence
  Description of Artificial Sequence: Synthetic peptide
  XENP018559 vlCDR2
YASHRYT

SEQ ID NO: 6925 - protein, 9 aa, Artificial Sequence
  Description of Artificial Sequence: Synthetic peptide
  XENP018559 vlCDR3
QQDYSSPRT

SEQ ID NO: 6926 - protein, 249 aa, Artificial Sequence
  Description of Artificial Sequence: Synthetic polypeptide
  XENP018560 1G6_H1.64_L1_scFv(GKPGS)4
EVQLVESGGGLVKPGGSLRLSCAASGFTFSNYWMNWVRQAPGKGLEWVGEITLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6927 - protein, 122 aa, Artificial Sequence
  Description of Artificial Sequence: Synthetic polypeptide
  VH of XENP018560
EVQLVESGGGLVKPGGSLRLSCAASGFTFSNYWMNWVRQAPGKGLEWVGEITLKSNNYATHYAEPVKGRFTISRDDSKSTVYLQMNSLKTEDTAVYYCTRYYGNYGGYFDVWGAGTLVTVSS

SEQ ID NO: 6928 - protein, 107 aa, Artificial Sequence; identical to SEQ ID NO: 6247
  Description of Artificial Sequence: Synthetic polypeptide
  VL of XENP018560

SEQ ID NO: 6929 - protein, 5 aa, Artificial Sequence
  Description of Artificial Sequence: Synthetic peptide
  XENP018560 vhCDR1
NYWMN

SEQ ID NO: 6930 - protein, 19 aa, Artificial Sequence
  Description of Artificial Sequence: Synthetic peptide
  XENP018560 vhCDR2
EITLKSNNYATHYAEPVKG

SEQ ID NO: 6931 - protein, 11 aa, Artificial Sequence
  Description of Artificial Sequence: Synthetic peptide
  XENP018560 vhCDR3
YYGNYGGYFDV

SEQ ID NO: 6932 - protein, 11 aa, Artificial Sequence
  Description of Artificial Sequence: Synthetic peptide
  XENP018560 vlCDR1
RASQSVSNDVA

SEQ ID NO: 6933 - protein, 7 aa, Artificial Sequence
  Description of Artificial Sequence: Synthetic peptide
  XENP018560 vlCDR2
YASHRYT

SEQ ID NO: 6934 - protein, 9 aa, Artificial Sequence
  Description of Artificial Sequence: Synthetic peptide
  XENP018560 vlCDR3
QQDYSSPRT

SEQ ID NO: 6935 - protein, 249 aa, Artificial Sequence
  Description of Artificial Sequence: Synthetic polypeptide
  XENP018561 1G6_H1.65_L1_scFv(GKPGS)4
EVQLVESGGGLVKPGGSLRLSCAASGFTFSNYWMNWVRQAPGKGLEWVGEIKLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6936 - protein, 122 aa, Artificial Sequence
  Description of Artificial Sequence: Synthetic polypeptide
  VH of XENP018561
EVQLVESGGGLVKPGGSLRLSCAASGFTFSNYWMNWVRQAPGKGLEWVGEIKLKSNNYATHYAEPVKGRFTISRDDSKSTVYLQMNSLKTEDTAVYYCTRYYGNYGGYFDVWGAGTLVTVSS

SEQ ID NO: 6937 - protein, 107 aa, Artificial Sequence; identical to SEQ ID NO: 6247
  Description of Artificial Sequence: Synthetic polypeptide
  VL of XENP018561

SEQ ID NO: 6938 - protein, 5 aa, Artificial Sequence
  Description of Artificial Sequence: Synthetic peptide
  XENP018561 vhCDR1
NYWMN

SEQ ID NO: 6939 - protein, 19 aa, Artificial Sequence
  Description of Artificial Sequence: Synthetic peptide
  XENP018561 vhCDR2
EIKLKSNNYATHYAEPVKG

SEQ ID NO: 6940 - protein, 11 aa, Artificial Sequence
  Description of Artificial Sequence: Synthetic peptide
  XENP018561 vhCDR3
YYGNYGGYFDV

SEQ ID NO: 6941 - protein, 11 aa, Artificial Sequence
  Description of Artificial Sequence: Synthetic peptide
  XENP018561 vlCDR1
RASQSVSNDVA

SEQ ID NO: 6942 - protein, 7 aa, Artificial Sequence
  Description of Artificial Sequence: Synthetic peptide
  XENP018561 vlCDR2
YASHRYT

SEQ ID NO: 6943 - protein, 9 aa, Artificial Sequence
  Description of Artificial Sequence: Synthetic peptide
  XENP018561 vlCDR3
QQDYSSPRT

SEQ ID NO: 6944 - protein, 249 aa, Artificial Sequence
  Description of Artificial Sequence: Synthetic polypeptide
  XENP018562 1G6_H1.66_L1_scFv(GKPGS)4
EVQLVESGGGLVKPGGSLRLSCAASGFTFSNYWMNWVRQAPGKGLEWVGEIELKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6945 - protein, 122 aa, Artificial Sequence
  Description of Artificial Sequence: Synthetic polypeptide
  VH of XENP018562
EVQLVESGGGLVKPGGSLRLSCAASGFTFSNYWMNWVRQAPGKGLEWVGEIELKSNNYATHYAEPVKGRFTISRDDSKSTVYLQMNSLKTEDTAVYYCTRYYGNYGGYFDVWGAGTLVTVSS

SEQ ID NO: 6946 - protein, 107 aa, Artificial Sequence; identical to SEQ ID NO: 6247
  Description of Artificial Sequence: Synthetic polypeptide
  VL of XENP018562

SEQ ID NO: 6947 - protein, 5 aa, Artificial Sequence
  Description of Artificial Sequence: Synthetic peptide
  XENP018562 vhCDR1
NYWMN

SEQ ID NO: 6948 - protein, 19 aa, Artificial Sequence
  Description of Artificial Sequence: Synthetic peptide
  XENP018562 vhCDR2
EIELKSNNYATHYAEPVKG

SEQ ID NO: 6949 - protein, 11 aa, Artificial Sequence
  Description of Artificial Sequence: Synthetic peptide
  XENP018562 vhCDR3
YYGNYGGYFDV

SEQ ID NO: 6950 - protein, 11 aa, Artificial Sequence
  Description of Artificial Sequence: Synthetic peptide
  XENP018562 vlCDR1
RASQSVSNDVA

SEQ ID NO: 6951 - protein, 7 aa, Artificial Sequence
  Description of Artificial Sequence: Synthetic peptide
  XENP018562 vlCDR2
YASHRYT

SEQ ID NO: 6952 - protein, 9 aa, Artificial Sequence
  Description of Artificial Sequence: Synthetic peptide
  XENP018562 vlCDR3
QQDYSSPRT

SEQ ID NO: 6953 - protein, 249 aa, Artificial Sequence
  Description of Artificial Sequence: Synthetic polypeptide
  XENP018563 1G6_H1.67_L1_scFv(GKPGS)4
EVQLVESGGGLVKPGGSLRLSCAASGFTFSNYWMNWVRQAPGKGLEWVGEIDLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6954 - protein, 122 aa, Artificial Sequence
  Description of Artificial Sequence: Synthetic polypeptide
  VH of XENP018563
EVQLVESGGGLVKPGGSLRLSCAASGFTFSNYWMNWVRQAPGKGLEWVGEIDLKSNNYATHYAEPVKGRFTISRDDSKSTVYLQMNSLKTEDTAVYYCTRYYGNYGGYFDVWGAGTLVTVSS

SEQ ID NO: 6955 - protein, 107 aa, Artificial Sequence; identical to SEQ ID NO: 6247
  Description of Artificial Sequence: Synthetic polypeptide
  VL of XENP018563

SEQ ID NO: 6956 - protein, 5 aa, Artificial Sequence
  Description of Artificial Sequence: Synthetic peptide
  XENP018563 vhCDR1
NYWMN

SEQ ID NO: 6957 - protein, 19 aa, Artificial Sequence
  Description of Artificial Sequence: Synthetic peptide
  XENP018563 vhCDR2
EIDLKSNNYATHYAEPVKG

SEQ ID NO: 6958 - protein, 11 aa, Artificial Sequence
  Description of Artificial Sequence: Synthetic peptide
  XENP018563 vhCDR3
YYGNYGGYFDV

SEQ ID NO: 6959 - protein, 11 aa, Artificial Sequence
  Description of Artificial Sequence: Synthetic peptide
  XENP018563 vlCDR1
RASQSVSNDVA

SEQ ID NO: 6960 - protein, 7 aa, Artificial Sequence
  Description of Artificial Sequence: Synthetic peptide
  XENP018563 vlCDR2
YASHRYT

SEQ ID NO: 6961 - protein, 9 aa, Artificial Sequence
  Description of Artificial Sequence: Synthetic peptide
  XENP018563 vlCDR3
QQDYSSPRT

SEQ ID NO: 6962 - protein, 249 aa, Artificial Sequence
  Description of Artificial Sequence: Synthetic polypeptide
  XENP018564 1G6_H1.68_L1_scFv(GKPGS)4
EVQLVESGGGLVKPGGSLRLSCAASGFTFSNYWMNWVRQAPGKGLEWVGEIHLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6963 - protein, 122 aa, Artificial Sequence
  Description of Artificial Sequence: Synthetic polypeptide
  VH of XENP018564
EVQLVESGGGLVKPGGSLRLSCAASGFTFSNYWMNWVRQAPGKGLEWVGEIHLKSNNYATHYAEPVKGRFTISRDDSKSTVYLQMNSLKTEDTAVYYCTRYYGNYGGYFDVWGAGTLVTVSS

SEQ ID NO: 6964 - protein, 107 aa, Artificial Sequence; identical to SEQ ID NO: 6247
  Description of Artificial Sequence: Synthetic polypeptide
  VL of XENP018564

SEQ ID NO: 6965 - protein, 5 aa, Artificial Sequence
  Description of Artificial Sequence: Synthetic peptide
  XENP018564 vhCDR1
NYWMN

SEQ ID NO: 6966 - protein, 19 aa, Artificial Sequence
  Description of Artificial Sequence: Synthetic peptide
  XENP018564 vhCDR2
EIHLKSNNYATHYAEPVKG

SEQ ID NO: 6967 - protein, 11 aa, Artificial Sequence
  Description of Artificial Sequence: Synthetic peptide
  XENP018564 vhCDR3
YYGNYGGYFDV

SEQ ID NO: 6968 - protein, 11 aa, Artificial Sequence
  Description of Artificial Sequence: Synthetic peptide
  XENP018564 vlCDR1
RASQSVSNDVA

SEQ ID NO: 6969 - protein, 7 aa, Artificial Sequence
  Description of Artificial Sequence: Synthetic peptide
  XENP018564 vlCDR2
YASHRYT

SEQ ID NO: 6970 - protein, 9 aa, Artificial Sequence
  Description of Artificial Sequence: Synthetic peptide
  XENP018564 vlCDR3
QQDYSSPRT

SEQ ID NO: 6971 - protein, 249 aa, Artificial Sequence
  Description of Artificial Sequence: Synthetic polypeptide
  XENP018565 1G6_H1.69_L1_scFv(GKPGS)4
EVQLVESGGGLVKPGGSLRLSCAASGFTFSNYWMNWVRQAPGKGLEWVGEISLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6972 - protein, 122 aa, Artificial Sequence
  Description of Artificial Sequence: Synthetic polypeptide
  VH of XENP018565
EVQLVESGGGLVKPGGSLRLSCAASGFTFSNYWMNWVRQAPGKGLEWVGEISLKSNNYATHYAEPVKGRFTISRDDSKSTVYLQMNSLKTEDTAVYYCTRYYGNYGGYFDVWGAGTLVTVSS

SEQ ID NO: 6973 - protein, 107 aa, Artificial Sequence; identical to SEQ ID NO: 6247
  Description of Artificial Sequence: Synthetic polypeptide
  VL of XENP018565

SEQ ID NO: 6974 - protein, 5 aa, Artificial Sequence
  Description of Artificial Sequence: Synthetic peptide
  XENP018565 vhCDR1
NYWMN

SEQ ID NO: 6975 - protein, 19 aa, Artificial Sequence
  Description of Artificial Sequence: Synthetic peptide
  XENP018565 vhCDR2
EISLKSNNYATHYAEPVKG

SEQ ID NO: 6976 - protein, 11 aa, Artificial Sequence
  Description of Artificial Sequence: Synthetic peptide
  XENP018565 vhCDR3
YYGNYGGYFDV

SEQ ID NO: 6977 - protein, 11 aa, Artificial Sequence
  Description of Artificial Sequence: Synthetic peptide
  XENP018565 vlCDR1
RASQSVSNDVA

SEQ ID NO: 6978 - protein, 7 aa, Artificial Sequence
  Description of Artificial Sequence: Synthetic peptide
  XENP018565 vlCDR2
YASHRYT

SEQ ID NO: 6979 - protein, 9 aa, Artificial Sequence
  Description of Artificial Sequence: Synthetic peptide
  XENP018565 vlCDR3
QQDYSSPRT

SEQ ID NO: 6980 - protein, 249 aa, Artificial Sequence
  Description of Artificial Sequence: Synthetic polypeptide
  XENP018566 1G6_H1.70_L1_scFv(GKPGS)4
EVQLVESGGGLVKPGGSLRLSCAASGFTFSNYWMNWVRQAPGKGLEWVGEIGLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6981 - protein, 122 aa, Artificial Sequence
  Description of Artificial Sequence: Synthetic polypeptide
  VH of XENP018566
EVQLVESGGGLVKPGGSLRLSCAASGFTFSNYWMNWVRQAPGKGLEWVGEIGLKSNNYATHYAEPVKGRFTISRDDSKSTVYLQMNSLKTEDTAVYYCTRYYGNYGGYFDVWGAGTLVTVSS

SEQ ID NO: 6982 - protein, 107 aa, Artificial Sequence; identical to SEQ ID NO: 6247
  Description of Artificial Sequence: Synthetic polypeptide
  VL of XENP018566

SEQ ID NO: 6983 - protein, 5 aa, Artificial Sequence
  Description of Artificial Sequence: Synthetic peptide
  XENP018566 vhCDR1
NYWMN

SEQ ID NO: 6984 - protein, 19 aa, Artificial Sequence
  Description of Artificial Sequence: Synthetic peptide
  XENP018566 vhCDR2
EIGLKSNNYATHYAEPVKG

SEQ ID NO: 6985 - protein, 11 aa, Artificial Sequence
  Description of Artificial Sequence: Synthetic peptide
  XENP018566 vhCDR3
YYGNYGGYFDV

SEQ ID NO: 6986 - protein, 11 aa, Artificial Sequence
  Description of Artificial Sequence: Synthetic peptide
  XENP018566 vlCDR1
RASQSVSNDVA

SEQ ID NO: 6987 - protein, 7 aa, Artificial Sequence
  Description of Artificial Sequence: Synthetic peptide
  XENP018566 vlCDR2
YASHRYT

SEQ ID NO: 6988 - protein, 9 aa, Artificial Sequence
  Description of Artificial Sequence: Synthetic peptide
  XENP018566 vlCDR3
QQDYSSPRT

SEQ ID NO: 6989 - protein, 249 aa, Artificial Sequence
  Description of Artificial Sequence: Synthetic polypeptide
  XENP018567 1G6_H1.71_L1_scFv(GKPGS)4
EVQLVESGGGLVKPGGSLRLSCAASGFTFSNYWMNWVRQAPGKGLEWVGEIYLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6990 - protein, 122 aa, Artificial Sequence
  Description of Artificial Sequence: Synthetic polypeptide
  VH of XENP018567
EVQLVESGGGLVKPGGSLRLSCAASGFTFSNYWMNWVRQAPGKGLEWVGEIYLKSNNYATHYAEPVKGRFTISRDDSKSTVYLQMNSLKTEDTAVYYCTRYYGNYGGYFDVWGAGTLVTVSS

SEQ ID NO: 6991 - protein, 107 aa, Artificial Sequence; identical to SEQ ID NO: 6247
  Description of Artificial Sequence: Synthetic polypeptide
  VL of XENP018567

SEQ ID NO: 6992 - protein, 5 aa, Artificial Sequence
  Description of Artificial Sequence: Synthetic peptide
  XENP018567 vhCDR1
NYWMN

SEQ ID NO: 6993 - protein, 19 aa, Artificial Sequence
  Description of Artificial Sequence: Synthetic peptide
  XENP018567 vhCDR2
EIYLKSNNYATHYAEPVKG

SEQ ID NO: 6994 - protein, 11 aa, Artificial Sequence
  Description of Artificial Sequence: Synthetic peptide
  XENP018567 vhCDR3
YYGNYGGYFDV

SEQ ID NO: 6995 - protein, 11 aa, Artificial Sequence
  Description of Artificial Sequence: Synthetic peptide
  XENP018567 vlCDR1
RASQSVSNDVA

SEQ ID NO: 6996 - protein, 7 aa, Artificial Sequence
  Description of Artificial Sequence: Synthetic peptide
  XENP018567 vlCDR2
YASHRYT

SEQ ID NO: 6997 - protein, 9 aa, Artificial Sequence
  Description of Artificial Sequence: Synthetic peptide
  XENP018567 vlCDR3
QQDYSSPRT

SEQ ID NO: 6998 - protein, 249 aa, Artificial Sequence
  Description of Artificial Sequence: Synthetic polypeptide
  XENP018568 1G6_H1.72_L1_scFv(GKPGS)4
EVQLVESGGGLVKPGGSLRLSCAASGFTFSNYWMNWVRQAPGKGLEWVGEIILKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 6999 - protein, 122 aa, Artificial Sequence
  Description of Artificial Sequence: Synthetic polypeptide
  VH of XENP018568
EVQLVESGGGLVKPGGSLRLSCAASGFTFSNYWMNWVRQAPGKGLEWVGEIILKSNNYATHYAEPVKGRFTISRDDSKSTVYLQMNSLKTEDTAVYYCTRYYGNYGGYFDVWGAGTLVTVSS

SEQ ID NO: 7000 - protein, 107 aa, Artificial Sequence; identical to SEQ ID NO: 6247
  Description of Artificial Sequence: Synthetic polypeptide
  VL of XENP018568

SEQ ID NO: 7001 - protein, 5 aa, Artificial Sequence
  Description of Artificial Sequence: Synthetic peptide
  XENP018568 vhCDR1
NYWMN

SEQ ID NO: 7002 - protein, 19 aa, Artificial Sequence
  Description of Artificial Sequence: Synthetic peptide
  XENP018568 vhCDR2
EIILKSNNYATHYAEPVKG

SEQ ID NO: 7003 - protein, 11 aa, Artificial Sequence
  Description of Artificial Sequence: Synthetic peptide
  XENP018568 vhCDR3
YYGNYGGYFDV

SEQ ID NO: 7004 - protein, 11 aa, Artificial Sequence
  Description of Artificial Sequence: Synthetic peptide
  XENP018568 vlCDR1
RASQSVSNDVA

SEQ ID NO: 7005 - protein, 7 aa, Artificial Sequence
  Description of Artificial Sequence: Synthetic peptide
  XENP018568 vlCDR2
YASHRYT

SEQ ID NO: 7006 - protein, 9 aa, Artificial Sequence
  Description of Artificial Sequence: Synthetic peptide
  XENP018568 vlCDR3
QQDYSSPRT

SEQ ID NO: 7007 - protein, 249 aa, Artificial Sequence
  Description of Artificial Sequence: Synthetic polypeptide
  XENP018569 1G6_H1.73_L1_scFv(GKPGS)4
EVQLVESGGGLVKPGGSLRLSCAASGFTFSNYWMNWVRQAPGKGLEWVGEIWLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7008 - protein, 122 aa, Artificial Sequence
  Description of Artificial Sequence: Synthetic polypeptide
  VH of XENP018569
EVQLVESGGGLVKPGGSLRLSCAASGFTFSNYWMNWVRQAPGKGLEWVGEIWLKSNNYATHYAEPVKGRFTISRDDSKSTVYLQMNSLKTEDTAVYYCTRYYGNYGGYFDVWGAGTLVTVSS

SEQ ID NO: 7009 - protein, 107 aa, Artificial Sequence; identical to SEQ ID NO: 6247
  Description of Artificial Sequence: Synthetic polypeptide
  VL of XENP018569

SEQ ID NO: 7010 - protein, 5 aa, Artificial Sequence
  Description of Artificial Sequence: Synthetic peptide
  XENP018569 vhCDR1
NYWMN

SEQ ID NO: 7011 - protein, 19 aa, Artificial Sequence
  Description of Artificial Sequence: Synthetic peptide
  XENP018569 vhCDR2
EIWLKSNNYATHYAEPVKG

SEQ ID NO: 7012 - protein, 11 aa, Artificial Sequence
  Description of Artificial Sequence: Synthetic peptide
  XENP018569 vhCDR3
YYGNYGGYFDV

SEQ ID NO: 7013 - protein, 11 aa, Artificial Sequence
  Description of Artificial Sequence: Synthetic peptide
  XENP018569 vlCDR1
RASQSVSNDVA

SEQ ID NO: 7014 - protein, 7 aa, Artificial Sequence
  Description of Artificial Sequence: Synthetic peptide
  XENP018569 vlCDR2
YASHRYT

SEQ ID NO: 7015 - protein, 9 aa, Artificial Sequence
  Description of Artificial Sequence: Synthetic peptide
  XENP018569 vlCDR3
QQDYSSPRT

SEQ ID NO: 7016 - protein, 249 aa, Artificial Sequence
  Description of Artificial Sequence: Synthetic polypeptide
  XENP018570 1G6_H1.74_L1_scFv(GKPGS)4
EVQLVESGGGLVKPGGSLRLSCAASGFTFSNYWMNWVRQAPGKGLEWVGEIRIKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7017 - protein, 122 aa, Artificial Sequence
  Description of Artificial Sequence: Synthetic polypeptide
  VH of XENP018570
EVQLVESGGGLVKPGGSLRLSCAASGFTFSNYWMNWVRQAPGKGLEWVGEIRIKSNNYATHYAEPVKGRFTISRDDSKSTVYLQMNSLKTEDTAVYYCTRYYGNYGGYFDVWGAGTLVTVSS

SEQ ID NO: 7018 - protein, 107 aa, Artificial Sequence; identical to SEQ ID NO: 6247
  Description of Artificial Sequence: Synthetic polypeptide
  VL of XENP018570

SEQ ID NO: 7019 - protein, 5 aa, Artificial Sequence
  Description of Artificial Sequence: Synthetic peptide
  XENP018570 vhCDR1
NYWMN

SEQ ID NO: 7020 - protein, 19 aa, Artificial Sequence
  Description of Artificial Sequence: Synthetic peptide
  XENP018570 vhCDR2
EIRIKSNNYATHYAEPVKG

SEQ ID NO: 7021 - protein, 11 aa, Artificial Sequence
  Description of Artificial Sequence: Synthetic peptide
  XENP018570 vhCDR3
YYGNYGGYFDV

SEQ ID NO: 7022 - protein, 11 aa, Artificial Sequence
  Description of Artificial Sequence: Synthetic peptide
  XENP018570 vlCDR1
RASQSVSNDVA

SEQ ID NO: 7023 - protein, 7 aa, Artificial Sequence
  Description of Artificial Sequence: Synthetic peptide
  XENP018570 vlCDR2
YASHRYT

SEQ ID NO: 7024 - protein, 9 aa, Artificial Sequence
  Description of Artificial Sequence: Synthetic peptide
  XENP018570 vlCDR3
QQDYSSPRT

SEQ ID NO: 7025 - protein, 249 aa, Artificial Sequence
  Description of Artificial Sequence: Synthetic polypeptide
  XENP018571 1G6_H1.75_L1_scFv(GKPGS)4
EVQLVESGGGLVKPGGSLRLSCAASGFTFSNYWMNWVRQAPGKGLEWVGEIRFKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7026 - protein, 122 aa, Artificial Sequence
  Description of Artificial Sequence: Synthetic polypeptide
  VH of XENP018571
EVQLVESGGGLVKPGGSLRLSCAASGFTFSNYWMNWVRQAPGKGLEWVGEIRFKSNNYATHYAEPVKGRFTISRDDSKSTVYLQMNSLKTEDTAVYYCTRYYGNYGGYFDVWGAGTLVTVSS

SEQ ID NO: 7027 - protein, 107 aa, Artificial Sequence; identical to SEQ ID NO: 6247
  Description of Artificial Sequence: Synthetic polypeptide
  VL of XENP018571

SEQ ID NO: 7028 - protein, 5 aa, Artificial Sequence
  Description of Artificial Sequence: Synthetic peptide
  XENP018571 vhCDR1
NYWMN

SEQ ID NO: 7029 - protein, 19 aa, Artificial Sequence
  Description of Artificial Sequence: Synthetic peptide
  XENP018571 vhCDR2
EIRFKSNNYATHYAEPVKG

SEQ ID NO: 7030 - protein, 11 aa, Artificial Sequence
  Description of Artificial Sequence: Synthetic peptide
  XENP018571 vhCDR3
YYGNYGGYFDV

SEQ ID NO: 7031 - protein, 11 aa, Artificial Sequence
  Description of Artificial Sequence: Synthetic peptide
  XENP018571 vlCDR1
RASQSVSNDVA

SEQ ID NO: 7032 - protein, 7 aa, Artificial Sequence
  Description of Artificial Sequence: Synthetic peptide
  XENP018571 vlCDR2
YASHRYT

SEQ ID NO: 7033 - protein, 9 aa, Artificial Sequence
  Description of Artificial Sequence: Synthetic peptide
  XENP018571 vlCDR3
QQDYSSPRT

SEQ ID NO: 7034 - protein, 249 aa, Artificial Sequence
  Description of Artificial Sequence: Synthetic polypeptide
  XENP018572 1G6_H1.76_L1_scFv(GKPGS)4
EVQLVESGGGLVKPGGSLRLSCAASGFTFSNYWMNWVRQAPGKGLEWVGEIRVKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7035 - protein, 122 aa, Artificial Sequence
  Description of Artificial Sequence: Synthetic polypeptide
  VH of XENP018572
EVQLVESGGGLVKPGGSLRLSCAASGFTFSNYWMNWVRQAPGKGLEWVGEIRVKSNNYATHYAEPVKGRFTISRDDSKSTVYLQMNSLKTEDTAVYYCTRYYGNYGGYFDVWGAGTLVTVSS

SEQ ID NO: 7036 - protein, 107 aa, Artificial Sequence; identical to SEQ ID NO: 6247
  Description of Artificial Sequence: Synthetic polypeptide
  VL of XENP018572

SEQ ID NO: 7037 - protein, 5 aa, Artificial Sequence
  Description of Artificial Sequence: Synthetic peptide
  XENP018572 vhCDR1
NYWMN

SEQ ID NO: 7038 - protein, 19 aa, Artificial Sequence
  Description of Artificial Sequence: Synthetic peptide
  XENP018572 vhCDR2
EIRVKSNNYATHYAEPVKG

SEQ ID NO: 7039 - protein, 11 aa, Artificial Sequence
  Description of Artificial Sequence: Synthetic peptide
  XENP018572 vhCDR3
YYGNYGGYFDV

SEQ ID NO: 7040 - protein, 11 aa, Artificial Sequence
  Description of Artificial Sequence: Synthetic peptide
  XENP018572 vlCDR1
RASQSVSNDVA

SEQ ID NO: 7041 - protein, 7 aa, Artificial Sequence
  Description of Artificial Sequence: Synthetic peptide
  XENP018572 vlCDR2
YASHRYT

SEQ ID NO: 7042 - protein, 9 aa, Artificial Sequence
  Description of Artificial Sequence: Synthetic peptide
  XENP018572 vlCDR3
QQDYSSPRT

SEQ ID NO: 7043 - protein, 249 aa, Artificial Sequence
  Description of Artificial Sequence: Synthetic polypeptide
  XENP018573 1G6_H1.77_L1_scFv(GKPGS)4
EVQLVESGGGLVKPGGSLRLSCAASGFTFSNYWMNWVRQAPGKGLEWVGEIRYKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7044 - protein, 122 aa, Artificial Sequence
  Description of Artificial Sequence: Synthetic polypeptide
  VH of XENP018573
EVQLVESGGGLVKPGGSLRLSCAASGFTFSNYWMNWVRQAPGKGLEWVGEIRYKSNNYATHYAEPVKGRFTISRDDSKSTVYLQMNSLKTEDTAVYYCTRYYGNYGGYFDVWGAGTLVTVSS

SEQ ID NO: 7045 - protein, 107 aa, Artificial Sequence; identical to SEQ ID NO: 6247
  Description of Artificial Sequence: Synthetic polypeptide
  VL of XENP018573

SEQ ID NO: 7046 - protein, 5 aa, Artificial Sequence
  Description of Artificial Sequence: Synthetic peptide
  XENP018573 vhCDR1
NYWMN

SEQ ID NO: 7047 - protein, 19 aa, Artificial Sequence
  Description of Artificial Sequence: Synthetic peptide
  XENP018573 vhCDR2
EIRYKSNNYATHYAEPVKG

SEQ ID NO: 7048 - protein, 11 aa, Artificial Sequence
  Description of Artificial Sequence: Synthetic peptide
  XENP018573 vhCDR3
YYGNYGGYFDV

SEQ ID NO: 7049 - protein, 11 aa, Artificial Sequence
  Description of Artificial Sequence: Synthetic peptide
  XENP018573 vlCDR1
RASQSVSNDVA

SEQ ID NO: 7050 - protein, 7 aa, Artificial Sequence
  Description of Artificial Sequence: Synthetic peptide
  XENP018573 vlCDR2
YASHRYT

SEQ ID NO: 7051 - protein, 9 aa, Artificial Sequence
  Description of Artificial Sequence: Synthetic peptide
  XENP018573 vlCDR3
QQDYSSPRT

SEQ ID NO: 7052 - protein, 249 aa, Artificial Sequence
  Description of Artificial Sequence: Synthetic polypeptide
  XENP018574 1G6_H1.78_L1_scFv(GKPGS)4
EVQLVESGGGLVKPGGSLRLSCAASGFTFSNYWMNWVRQAPGKGLEWVGEIRWKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7053 - protein, 122 aa, Artificial Sequence
  Description of Artificial Sequence: Synthetic polypeptide
  VH of XENP018574
EVQLVESGGGLVKPGGSLRLSCAASGFTFSNYWMNWVRQAPGKGLEWVGEIRWKSNNYATHYAEPVKGRFTISRDDSKSTVYLQMNSLKTEDTAVYYCTRYYGNYGGYFDVWGAGTLVTVSS

SEQ ID NO: 7054 - protein, 107 aa, Artificial Sequence; identical to SEQ ID NO: 6247
  Description of Artificial Sequence: Synthetic polypeptide
  VL of XENP018574

SEQ ID NO: 7055 - protein, 5 aa, Artificial Sequence
  Description of Artificial Sequence: Synthetic peptide
  XENP018574 vhCDR1
NYWMN

SEQ ID NO: 7056 - protein, 19 aa, Artificial Sequence
  Description of Artificial Sequence: Synthetic peptide
  XENP018574 vhCDR2
EIRWKSNNYATHYAEPVKG

SEQ ID NO: 7057 - protein, 11 aa, Artificial Sequence
  Description of Artificial Sequence: Synthetic peptide
  XENP018574 vhCDR3
YYGNYGGYFDV

SEQ ID NO: 7058 - protein, 11 aa, Artificial Sequence
  Description of Artificial Sequence: Synthetic peptide
  XENP018574 vlCDR1
RASQSVSNDVA

SEQ ID NO: 7059 - protein, 7 aa, Artificial Sequence
  Description of Artificial Sequence: Synthetic peptide
  XENP018574 vlCDR2
YASHRYT

SEQ ID NO: 7060 - protein, 9 aa, Artificial Sequence
  Description of Artificial Sequence: Synthetic peptide
  XENP018574 vlCDR3
QQDYSSPRT

SEQ ID NO: 7061 - protein, 249 aa, Artificial Sequence
  Description of Artificial Sequence: Synthetic polypeptide
  XENP018575 1G6_H1.79_L1_scFv(GKPGS)4
EVQLVESGGGLVKPGGSLRLSCAASGFTFSNYWMNWVRQAPGKGLEWVGEIRDKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7062 - protein, 122 aa, Artificial Sequence
  Description of Artificial Sequence: Synthetic polypeptide
  VH of XENP018575
EVQLVESGGGLVKPGGSLRLSCAASGFTFSNYWMNWVRQAPGKGLEWVGEIRDKSNNYATHYAEPVKGRFTISRDDSKSTVYLQMNSLKTEDTAVYYCTRYYGNYGGYFDVWGAGTLVTVSS

SEQ ID NO: 7063 - protein, 107 aa, Artificial Sequence; identical to SEQ ID NO: 6247
  Description of Artificial Sequence: Synthetic polypeptide
  VL of XENP018575

SEQ ID NO: 7064 - protein, 5 aa, Artificial Sequence
  Description of Artificial Sequence: Synthetic peptide
  XENP018575 vhCDR1
NYWMN

SEQ ID NO: 7065 - protein, 19 aa, Artificial Sequence
  Description of Artificial Sequence: Synthetic peptide
  XENP018575 vhCDR2
EIRDKSNNYATHYAEPVKG

SEQ ID NO: 7066 - protein, 11 aa, Artificial Sequence
  Description of Artificial Sequence: Synthetic peptide
  XENP018575 vhCDR3
YYGNYGGYFDV

SEQ ID NO: 7067 - protein, 11 aa, Artificial Sequence
  Description of Artificial Sequence: Synthetic peptide
  XENP018575 vlCDR1
RASQSVSNDVA

SEQ ID NO: 7068 - protein, 7 aa, Artificial Sequence
  Description of Artificial Sequence: Synthetic peptide
  XENP018575 vlCDR2
YASHRYT

SEQ ID NO: 7069 - protein, 9 aa, Artificial Sequence
  Description of Artificial Sequence: Synthetic peptide
  XENP018575 vlCDR3
QQDYSSPRT

SEQ ID NO: 7070 - protein, 249 aa, Artificial Sequence
  Description of Artificial Sequence: Synthetic polypeptide
  XENP018576 1G6_H1.80_L1_scFv(GKPGS)4
EVQLVESGGGLVKPGGSLRLSCAASGFTFSNYWMNWVRQAPGKGLEWVGEIRAKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7071 - protein, 122 aa, Artificial Sequence
  Description of Artificial Sequence: Synthetic polypeptide
  VH of XENP018576
EVQLVESGGGLVKPGGSLRLSCAASGFTFSNYWMNWVRQAPGKGLEWVGEIRAKSNNYATHYAEPVKGRFTISRDDSKSTVYLQMNSLKTEDTAVYYCTRYYGNYGGYFDVWGAGTLVTVSS

SEQ ID NO: 7072 - protein, 107 aa, Artificial Sequence; identical to SEQ ID NO: 6247
  Description of Artificial Sequence: Synthetic polypeptide
  VL of XENP018576

SEQ ID NO: 7073 - protein, 5 aa, Artificial Sequence
  Description of Artificial Sequence: Synthetic peptide
  XENP018576 vhCDR1
NYWMN

SEQ ID NO: 7074 - protein, 19 aa, Artificial Sequence
  Description of Artificial Sequence: Synthetic peptide
  XENP018576 vhCDR2
EIRAKSNNYATHYAEPVKG

SEQ ID NO: 7075 - protein, 11 aa, Artificial Sequence
  Description of Artificial Sequence: Synthetic peptide
  XENP018576 vhCDR3
YYGNYGGYFDV

SEQ ID NO: 7076 - protein, 11 aa, Artificial Sequence
  Description of Artificial Sequence: Synthetic peptide
  XENP018576 vlCDR1
RASQSVSNDVA

SEQ ID NO: 7077 - protein, 7 aa, Artificial Sequence
  Description of Artificial Sequence: Synthetic peptide
  XENP018576 vlCDR2
YASHRYT

SEQ ID NO: 7078 - protein, 9 aa, Artificial Sequence
  Description of Artificial Sequence: Synthetic peptide
  XENP018576 vlCDR3
QQDYSSPRT

SEQ ID NO: 7079 - protein, 249 aa, Artificial Sequence
  Description of Artificial Sequence: Synthetic polypeptide
  XENP018577 1G6_H1.81_L1_scFv(GKPGS)4
EVQLVESGGGLVKPGGSLRLSCAASGFTFSNYWMNWVRQAPGKGLEWVGEIRQKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7080 - protein, 122 aa, Artificial Sequence
  Description of Artificial Sequence: Synthetic polypeptide
  VH of XENP018577
EVQLVESGGGLVKPGGSLRLSCAASGFTFSNYWMNWVRQAPGKGLEWVGEIRQKSNNYATHYAEPVKGRFTISRDDSKSTVYLQMNSLKTEDTAVYYCTRYYGNYGGYFDVWGAGTLVTVSS

SEQ ID NO: 7081 - protein, 107 aa, Artificial Sequence; identical to SEQ ID NO: 6247
  Description of Artificial Sequence: Synthetic polypeptide
  VL of XENP018577

SEQ ID NO: 7082 - protein, 5 aa, Artificial Sequence
  Description of Artificial Sequence: Synthetic peptide
  XENP018577 vhCDR1
NYWMN

SEQ ID NO: 7083 - protein, 19 aa, Artificial Sequence
  Description of Artificial Sequence: Synthetic peptide
  XENP018577 vhCDR2
EIRQKSNNYATHYAEPVKG

SEQ ID NO: 7084 - protein, 11 aa, Artificial Sequence
  Description of Artificial Sequence: Synthetic peptide
  XENP018577 vhCDR3
YYGNYGGYFDV

SEQ ID NO: 7085 - protein, 11 aa, Artificial Sequence
  Description of Artificial Sequence: Synthetic peptide
  XENP018577 vlCDR1
RASQSVSNDVA

SEQ ID NO: 7086 - protein, 7 aa, Artificial Sequence
  Description of Artificial Sequence: Synthetic peptide
  XENP018577 vlCDR2
YASHRYT

SEQ ID NO: 7087 - protein, 9 aa, Artificial Sequence
  Description of Artificial Sequence: Synthetic peptide
  XENP018577 vlCDR3
QQDYSSPRT

SEQ ID NO: 7088 - protein, 249 aa, Artificial Sequence
  Description of Artificial Sequence: Synthetic polypeptide
  XENP018578 1G6_H1.82_L1_scFv(GKPGS)4
EVQLVESGGGLVKPGGSLRLSCAASGFTFSNYWMNWVRQAPGKGLEWVGEIRKKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7089 - protein, 122 aa, Artificial Sequence
  Description of Artificial Sequence: Synthetic polypeptide
  VH of XENP018578
EVQLVESGGGLVKPGGSLRLSCAASGFTFSNYWMNWVRQAPGKGLEWVGEIRKKSNNYATHYAEPVKGRFTISRDDSKSTVYLQMNSLKTEDTAVYYCTRYYGNYGGYFDVWGAGTLVTVSS

SEQ ID NO: 7090 - protein, 107 aa, Artificial Sequence; identical to SEQ ID NO: 6247
  Description of Artificial Sequence: Synthetic polypeptide
  VL of XENP018578

SEQ ID NO: 7091 - protein, 5 aa, Artificial Sequence
  Description of Artificial Sequence: Synthetic peptide
  XENP018578 vhCDR1
NYWMN

SEQ ID NO: 7092 - protein, 19 aa, Artificial Sequence
  Description of Artificial Sequence: Synthetic peptide
  XENP018578 vhCDR2
EIRKKSNNYATHYAEPVKG

SEQ ID NO: 7093 - protein, 11 aa, Artificial Sequence
  Description of Artificial Sequence: Synthetic peptide
  XENP018578 vhCDR3
YYGNYGGYFDV

SEQ ID NO: 7094 - protein, 11 aa, Artificial Sequence
  Description of Artificial Sequence: Synthetic peptide
  XENP018578 vlCDR1
RASQSVSNDVA

SEQ ID NO: 7095 - protein, 7 aa, Artificial Sequence
  Description of Artificial Sequence: Synthetic peptide
  XENP018578 vlCDR2
YASHRYT

SEQ ID NO: 7096 - protein, 9 aa, Artificial Sequence
  Description of Artificial Sequence: Synthetic peptide
  XENP018578 vlCDR3
QQDYSSPRT

SEQ ID NO: 7097 - protein, 249 aa, Artificial Sequence
  Description of Artificial Sequence: Synthetic polypeptide
  XENP018579 1G6_H1.83_L1_scFv(GKPGS)4
EVQLVESGGGLVKPGGSLRLSCAASGFTFSNYWMNWVRQAPGKGLEWVGEIRLRSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7098 - protein, 122 aa, Artificial Sequence
  Description of Artificial Sequence: Synthetic polypeptide
  VH of XENP018579
EVQLVESGGGLVKPGGSLRLSCAASGFTFSNYWMNWVRQAPGKGLEWVGEIRLRSNNYATHYAEPVKGRFTISRDDSKSTVYLQMNSLKTEDTAVYYCTRYYGNYGGYFDVWGAGTLVTVSS

SEQ ID NO: 7099 - protein, 107 aa, Artificial Sequence; identical to SEQ ID NO: 6247
  Description of Artificial Sequence: Synthetic polypeptide
  VL of XENP018579

SEQ ID NO: 7100 - protein, 5 aa, Artificial Sequence
  Description of Artificial Sequence: Synthetic peptide
  XENP018579 vhCDR1
NYWMN

SEQ ID NO: 7101 - protein, 19 aa, Artificial Sequence
  Description of Artificial Sequence: Synthetic peptide
  XENP018579 vhCDR2
EIRLRSNNYATHYAEPVKG

SEQ ID NO: 7102 - protein, 11 aa, Artificial Sequence
  Description of Artificial Sequence: Synthetic peptide
  XENP018579 vhCDR3
YYGNYGGYFDV

SEQ ID NO: 7103 - protein, 11 aa, Artificial Sequence
  Description of Artificial Sequence: Synthetic peptide
  XENP018579 vlCDR1
RASQSVSNDVA

SEQ ID NO: 7104 - protein, 7 aa, Artificial Sequence
  Description of Artificial Sequence: Synthetic peptide
  XENP018579 vlCDR2
YASHRYT

SEQ ID NO: 7105 - protein, 9 aa, Artificial Sequence
  Description of Artificial Sequence: Synthetic peptide
  XENP018579 vlCDR3
QQDYSSPRT

SEQ ID NO: 7106 - protein, 249 aa, Artificial Sequence
  Description of Artificial Sequence: Synthetic polypeptide
  XENP018580 1G6_H1.84_L1_scFv(GKPGS)4
EVQLVESGGGLVKPGGSLRLSCAASGFTFSNYWMNWVRQAPGKGLEWVGEIRLESNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7107 - protein, 122 aa, Artificial Sequence
  Description of Artificial Sequence: Synthetic polypeptide
  VH of XENP018580
EVQLVESGGGLVKPGGSLRLSCAASGFTFSNYWMNWVRQAPGKGLEWVGEIRLESNNYATHYAEPVKGRFTISRDDSKSTVYLQMNSLKTEDTAVYYCTRYYGNYGGYFDVWGAGTLVTVSS

SEQ ID NO: 7108 - protein, 107 aa, Artificial Sequence; identical to SEQ ID NO: 6247
  Description of Artificial Sequence: Synthetic polypeptide
  VL of XENP018580

SEQ ID NO: 7109 - protein, 5 aa, Artificial Sequence
  Description of Artificial Sequence: Synthetic peptide
  XENP018580 vhCDR1
NYWMN

SEQ ID NO: 7110 - protein, 19 aa, Artificial Sequence
  Description of Artificial Sequence: Synthetic peptide
  XENP018580 vhCDR2
EIRLESNNYATHYAEPVKG

SEQ ID NO: 7111 - protein, 11 aa, Artificial Sequence
  Description of Artificial Sequence: Synthetic peptide
  XENP018580 vhCDR3
YYGNYGGYFDV

SEQ ID NO: 7112 - protein, 11 aa, Artificial Sequence
  Description of Artificial Sequence: Synthetic peptide
  XENP018580 vlCDR1
RASQSVSNDVA

SEQ ID NO: 7113 - protein, 7 aa, Artificial Sequence
  Description of Artificial Sequence: Synthetic peptide
  XENP018580 vlCDR2
YASHRYT

SEQ ID NO: 7114 - protein, 9 aa, Artificial Sequence
  Description of Artificial Sequence: Synthetic peptide
  XENP018580 vlCDR3
QQDYSSPRT

SEQ ID NO: 7115 - protein, 249 aa, Artificial Sequence
  Description of Artificial Sequence: Synthetic polypeptide
  XENP018581 1G6_H1.85_L1_scFv(GKPGS)4
EVQLVESGGGLVKPGGSLRLSCAASGFTFSNYWMNWVRQAPGKGLEWVGEIRLHSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7116 - protein, 122 aa, Artificial Sequence
  Description of Artificial Sequence: Synthetic polypeptide
  VH of XENP018581
EVQLVESGGGLVKPGGSLRLSCAASGFTFSNYWMNWVRQAPGKGLEWVGEIRLHSNNYATHYAEPVKGRFTISRDDSKSTVYLQMNSLKTEDTAVYYCTRYYGNYGGYFDVWGAGTLVTVSS

SEQ ID NO: 7117 - protein, 107 aa, Artificial Sequence; identical to SEQ ID NO: 6247
  Description of Artificial Sequence: Synthetic polypeptide
  VL of XENP018581

SEQ ID NO: 7118 - protein, 5 aa, Artificial Sequence
  Description of Artificial Sequence: Synthetic peptide
  XENP018581 vhCDR1
NYWMN

SEQ ID NO: 7119 - protein, 19 aa, Artificial Sequence
  Description of Artificial Sequence: Synthetic peptide
  XENP018581 vhCDR2
EIRLHSNNYATHYAEPVKG

SEQ ID NO: 7120 - protein, 11 aa, Artificial Sequence
  Description of Artificial Sequence: Synthetic peptide
  XENP018581 vhCDR3
YYGNYGGYFDV

SEQ ID NO: 7121 - protein, 11 aa, Artificial Sequence
  Description of Artificial Sequence: Synthetic peptide
  XENP018581 vlCDR1
RASQSVSNDVA

SEQ ID NO: 7122 - protein, 7 aa, Artificial Sequence
  Description of Artificial Sequence: Synthetic peptide
  XENP018581 vlCDR2
YASHRYT

SEQ ID NO: 7123 - protein, 9 aa, Artificial Sequence
  Description of Artificial Sequence: Synthetic peptide
  XENP018581 vlCDR3
QQDYSSPRT

SEQ ID NO: 7124 - protein, 249 aa, Artificial Sequence
  Description of Artificial Sequence: Synthetic polypeptide
  XENP018582 1G6_H1.86_L1_scFv(GKPGS)4
EVQLVESGGGLVKPGGSLRLSCAASGFTFSNYWMNWVRQAPGKGLEWVGEIRLSSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7125 - protein, 122 aa, Artificial Sequence
  Description of Artificial Sequence: Synthetic polypeptide
  VH of XENP018582
EVQLVESGGGLVKPGGSLRLSCAASGFTFSNYWMNWVRQAPGKGLEWVGEIRLSSNNYATHYAEPVKGRFTISRDDSKSTVYLQMNSLKTEDTAVYYCTRYYGNYGGYFDVWGAGTLVTVSS

SEQ ID NO: 7126 - protein, 107 aa, Artificial Sequence; identical to SEQ ID NO: 6247
  Description of Artificial Sequence: Synthetic polypeptide
  VL of XENP018582

SEQ ID NO: 7127 - protein, 5 aa, Artificial Sequence
  Description of Artificial Sequence: Synthetic peptide
  XENP018582 vhCDR1
NYWMN

SEQ ID NO: 7128 - protein, 19 aa, Artificial Sequence
  Description of Artificial Sequence: Synthetic peptide
  XENP018582 vhCDR2
EIRLSSNNYATHYAEPVKG

SEQ ID NO: 7129 - protein, 11 aa, Artificial Sequence
  Description of Artificial Sequence: Synthetic peptide
  XENP018582 vhCDR3
YYGNYGGYFDV

SEQ ID NO: 7130 - protein, 11 aa, Artificial Sequence
  Description of Artificial Sequence: Synthetic peptide
  XENP018582 vlCDR1
RASQSVSNDVA

SEQ ID NO: 7131 - protein, 7 aa, Artificial Sequence
  Description of Artificial Sequence: Synthetic peptide
  XENP018582 vlCDR2
YASHRYT

SEQ ID NO: 7132 - protein, 9 aa, Artificial Sequence
  Description of Artificial Sequence: Synthetic peptide
  XENP018582 vlCDR3
QQDYSSPRT

SEQ ID NO: 7133 - protein, 249 aa, Artificial Sequence
  Description of Artificial Sequence: Synthetic polypeptide
  XENP018583 1G6_H1.87_L1_scFv(GKPGS)4
EVQLVESGGGLVKPGGSLRLSCAASGFTFSNYWMNWVRQAPGKGLEWVGEIRLDSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7134 - protein, 122 aa, Artificial Sequence
  Description of Artificial Sequence: Synthetic polypeptide
  VH of XENP018583
EVQLVESGGGLVKPGGSLRLSCAASGFTFSNYWMNWVRQAPGKGLEWVGEIRLDSNNYATHYAEPVKGRFTISRDDSKSTVYLQMNSLKTEDTAVYYCTRYYGNYGGYFDVWGAGTLVTVSS

SEQ ID NO: 7135 - protein, 107 aa, Artificial Sequence; identical to SEQ ID NO: 6247
  Description of Artificial Sequence: Synthetic polypeptide
  VL of XENP018583

SEQ ID NO: 7136 - protein, 5 aa, Artificial Sequence
  Description of Artificial Sequence: Synthetic peptide
  XENP018583 vhCDR1
NYWMN

SEQ ID NO: 7137 - protein, 19 aa, Artificial Sequence
  Description of Artificial Sequence: Synthetic peptide
  XENP018583 vhCDR2
EIRLDSNNYATHYAEPVKG

SEQ ID NO: 7138 - protein, 11 aa, Artificial Sequence
  Description of Artificial Sequence: Synthetic peptide
  XENP018583 vhCDR3
YYGNYGGYFDV

SEQ ID NO: 7139 - protein, 11 aa, Artificial Sequence
  Description of Artificial Sequence: Synthetic peptide
  XENP018583 vlCDR1
RASQSVSNDVA

SEQ ID NO: 7140 - protein, 7 aa, Artificial Sequence
  Description of Artificial Sequence: Synthetic peptide
  XENP018583 vlCDR2
YASHRYT

SEQ ID NO: 7141 - protein, 9 aa, Artificial Sequence
  Description of Artificial Sequence: Synthetic peptide
  XENP018583 vlCDR3
QQDYSSPRT

SEQ ID NO: 7142 - protein, 249 aa, Artificial Sequence
  Description of Artificial Sequence: Synthetic polypeptide
  XENP018584 1G6_H1.88_L1_scFv(GKPGS)4
EVQLVESGGGLVKPGGSLRLSCAASGFTFSNYWMNWVRQAPGKGLEWVGEIRLASNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7143 - protein, 122 aa, Artificial Sequence
  Description of Artificial Sequence: Synthetic polypeptide
  VH of XENP018584
EVQLVESGGGLVKPGGSLRLSCAASGFTFSNYWMNWVRQAPGKGLEWVGEIRLASNNYATHYAEPVKGRFTISRDDSKSTVYLQMNSLKTEDTAVYYCTRYYGNYGGYFDVWGAGTLVTVSS

SEQ ID NO: 7144 - protein, 107 aa, Artificial Sequence; identical to SEQ ID NO: 6247
  Description of Artificial Sequence: Synthetic polypeptide
  VL of XENP018584

SEQ ID NO: 7145 - protein, 5 aa, Artificial Sequence
  Description of Artificial Sequence: Synthetic peptide
  XENP018584 vhCDR1
NYWMN

SEQ ID NO: 7146 - protein, 19 aa, Artificial Sequence
  Description of Artificial Sequence: Synthetic peptide
  XENP018584 vhCDR2
EIRLASNNYATHYAEPVKG

SEQ ID NO: 7147 - protein, 11 aa, Artificial Sequence
  Description of Artificial Sequence: Synthetic peptide
  XENP018584 vhCDR3
YYGNYGGYFDV

SEQ ID NO: 7148 - protein, 11 aa, Artificial Sequence
  Description of Artificial Sequence: Synthetic peptide
  XENP018584 vlCDR1
RASQSVSNDVA

SEQ ID NO: 7149 - protein, 7 aa, Artificial Sequence
  Description of Artificial Sequence: Synthetic peptide
  XENP018584 vlCDR2
YASHRYT

SEQ ID NO: 7150 - protein, 9 aa, Artificial Sequence
  Description of Artificial Sequence: Synthetic peptide
  XENP018584 vlCDR3
QQDYSSPRT

SEQ ID NO: 7151 - protein, 249 aa, Artificial Sequence
  Description of Artificial Sequence: Synthetic polypeptide
  XENP018585 1G6_H1.89_L1_scFv(GKPGS)4
EVQLVESGGGLVKPGGSLRLSCAASGFTFSNYWMNWVRQAPGKGLEWVGEIRLGSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7152 - protein, 122 aa, Artificial Sequence
  Description of Artificial Sequence: Synthetic polypeptide
  VH of XENP018585
EVQLVESGGGLVKPGGSLRLSCAASGFTFSNYWMNWVRQAPGKGLEWVGEIRLGSNNYATHYAEPVKGRFTISRDDSKSTVYLQMNSLKTEDTAVYYCTRYYGNYGGYFDVWGAGTLVTVSS

SEQ ID NO: 7153 - protein, 107 aa, Artificial Sequence; identical to SEQ ID NO: 6247
  Description of Artificial Sequence: Synthetic polypeptide
  VL of XENP018585

SEQ ID NO: 7154 - protein, 5 aa, Artificial Sequence
  Description of Artificial Sequence: Synthetic peptide
  XENP018585 vhCDR1
NYWMN

SEQ ID NO: 7155 - protein, 19 aa, Artificial Sequence
  Description of Artificial Sequence: Synthetic peptide
  XENP018585 vhCDR2
EIRLGSNNYATHYAEPVKG

SEQ ID NO: 7156 - protein, 11 aa, Artificial Sequence
  Description of Artificial Sequence: Synthetic peptide
  XENP018585 vhCDR3
YYGNYGGYFDV

SEQ ID NO: 7157 - protein, 11 aa, Artificial Sequence
  Description of Artificial Sequence: Synthetic peptide
  XENP018585 vlCDR1
RASQSVSNDVA

SEQ ID NO: 7158 - protein, 7 aa, Artificial Sequence
  Description of Artificial Sequence: Synthetic peptide
  XENP018585 vlCDR2
YASHRYT

SEQ ID NO: 7159 - protein, 9 aa, Artificial Sequence
  Description of Artificial Sequence: Synthetic peptide
  XENP018585 vlCDR3
QQDYSSPRT

SEQ ID NO: 7160 - protein, 249 aa, Artificial Sequence
  Description of Artificial Sequence: Synthetic polypeptide
  XENP018586 1G6_H1.90_L1_scFv(GKPGS)4
EVQLVESGGGLVKPGGSLRLSCAASGFTFSNYWMNWVRQAPGKGLEWVGEIRLYSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7161 - protein, 122 aa, Artificial Sequence
  Description of Artificial Sequence: Synthetic polypeptide
  VH of XENP018586
EVQLVESGGGLVKPGGSLRLSCAASGFTFSNYWMNWVRQAPGKGLEWVGEIRLYSNNYATHYAEPVKGRFTISRDDSKSTVYLQMNSLKTEDTAVYYCTRYYGNYGGYFDVWGAGTLVTVSS

SEQ ID NO: 7162 - protein, 107 aa, Artificial Sequence; identical to SEQ ID NO: 6247
  Description of Artificial Sequence: Synthetic polypeptide
  VL of XENP018586

SEQ ID NO: 7163 - protein, 5 aa, Artificial Sequence
  Description of Artificial Sequence: Synthetic peptide
  XENP018586 vhCDR1
NYWMN

SEQ ID NO: 7164 - protein, 19 aa, Artificial Sequence
  Description of Artificial Sequence: Synthetic peptide
  XENP018586 vhCDR2
EIRLYSNNYATHYAEPVKG

SEQ ID NO: 7165 - protein, 11 aa, Artificial Sequence
  Description of Artificial Sequence: Synthetic peptide
  XENP018586 vhCDR3
YYGNYGGYFDV

SEQ ID NO: 7166 - protein, 11 aa, Artificial Sequence
  Description of Artificial Sequence: Synthetic peptide
  XENP018586 vlCDR1
RASQSVSNDVA

SEQ ID NO: 7167 - protein, 7 aa, Artificial Sequence
  Description of Artificial Sequence: Synthetic peptide
  XENP018586 vlCDR2
YASHRYT

SEQ ID NO: 7168 - protein, 9 aa, Artificial Sequence
  Description of Artificial Sequence: Synthetic peptide
  XENP018586 vlCDR3
QQDYSSPRT

SEQ ID NO: 7169 - protein, 249 aa, Artificial Sequence
  Description of Artificial Sequence: Synthetic polypeptide
  XENP018587 1G6_H1.91_L1_scFv(GKPGS)4
EVQLVESGGGLVKPGGSLRLSCAASGFTFSNYWMNWVRQAPGKGLEWVGEIRLISNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7170 - protein, 122 aa, Artificial Sequence
  Description of Artificial Sequence: Synthetic polypeptide
  VH of XENP018587
EVQLVESGGGLVKPGGSLRLSCAASGFTFSNYWMNWVRQAPGKGLEWVGEIRLISNNYATHYAEPVKGRFTISRDDSKSTVYLQMNSLKTEDTAVYYCTRYYGNYGGYFDVWGAGTLVTVSS

SEQ ID NO: 7171 - protein, 107 aa, Artificial Sequence; identical to SEQ ID NO: 6247
  Description of Artificial Sequence: Synthetic polypeptide
  VL of XENP018587

SEQ ID NO: 7172 - protein, 5 aa, Artificial Sequence
  Description of Artificial Sequence: Synthetic peptide
  XENP018587 vhCDR1
NYWMN

SEQ ID NO: 7173 - protein, 19 aa, Artificial Sequence
  Description of Artificial Sequence: Synthetic peptide
  XENP018587 vhCDR2
EIRLISNNYATHYAEPVKG

SEQ ID NO: 7174 - protein, 11 aa, Artificial Sequence
  Description of Artificial Sequence: Synthetic peptide
  XENP018587 vhCDR3
YYGNYGGYFDV

SEQ ID NO: 7175 - protein, 11 aa, Artificial Sequence
  Description of Artificial Sequence: Synthetic peptide
  XENP018587 vlCDR1
RASQSVSNDVA

SEQ ID NO: 7176 - protein, 7 aa, Artificial Sequence
  Description of Artificial Sequence: Synthetic peptide
  XENP018587 vlCDR2
YASHRYT

SEQ ID NO: 7177 - protein, 9 aa, Artificial Sequence
  Description of Artificial Sequence: Synthetic peptide
  XENP018587 vlCDR3
QQDYSSPRT

SEQ ID NO: 7178 - protein, 249 aa, Artificial Sequence
  Description of Artificial Sequence: Synthetic polypeptide
  XENP018588 1G6_H1.92_L1_scFv(GKPGS)4
EVQLVESGGGLVKPGGSLRLSCAASGFTFSNYWMNWVRQAPGKGLEWVGEIRLKTNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7179 - protein, 122 aa, Artificial Sequence
  Description of Artificial Sequence: Synthetic polypeptide
  VH of XENP018588
EVQLVESGGGLVKPGGSLRLSCAASGFTFSNYWMNWVRQAPGKGLEWVGEIRLKTNNYATHYAEPVKGRFTISRDDSKSTVYLQMNSLKTEDTAVYYCTRYYGNYGGYFDVWGAGTLVTVSS

SEQ ID NO: 7180 - protein, 107 aa, Artificial Sequence; identical to SEQ ID NO: 6247
  Description of Artificial Sequence: Synthetic polypeptide
  VL of XENP018588

SEQ ID NO: 7181 - protein, 5 aa, Artificial Sequence
  Description of Artificial Sequence: Synthetic peptide
  XENP018588 vhCDR1
NYWMN

SEQ ID NO: 7182 - protein, 19 aa, Artificial Sequence
  Description of Artificial Sequence: Synthetic peptide
  XENP018588 vhCDR2
EIRLKTNNYATHYAEPVKG

SEQ ID NO: 7183 - protein, 11 aa, Artificial Sequence
  Description of Artificial Sequence: Synthetic peptide
  XENP018588 vhCDR3
YYGNYGGYFDV

SEQ ID NO: 7184 - protein, 11 aa, Artificial Sequence
  Description of Artificial Sequence: Synthetic peptide
  XENP018588 vlCDR1
RASQSVSNDVA

SEQ ID NO: 7185 - protein, 7 aa, Artificial Sequence
  Description of Artificial Sequence: Synthetic peptide
  XENP018588 vlCDR2
YASHRYT

SEQ ID NO: 7186 - protein, 9 aa, Artificial Sequence
  Description of Artificial Sequence: Synthetic peptide
  XENP018588 vlCDR3
QQDYSSPRT

SEQ ID NO: 7187 - protein, 249 aa, Artificial Sequence
  Description of Artificial Sequence: Synthetic polypeptide
  XENP018589 1G6_H1.93_L1_scFv(GKPGS)4
EVQLVESGGGLVKPGGSLRLSCAASGFTFSNYWMNWVRQAPGKGLEWVGEIRLKANNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7188 - protein, 122 aa, Artificial Sequence
  Description of Artificial Sequence: Synthetic polypeptide
  VH of XENP018589
EVQLVESGGGLVKPGGSLRLSCAASGFTFSNYWMNWVRQAPGKGLEWVGEIRLKANNYATHYAEPVKGRFTISRDDSKSTVYLQMNSLKTEDTAVYYCTRYYGNYGGYFDVWGAGTLVTVSS

SEQ ID NO: 7189 - protein, 107 aa, Artificial Sequence; identical to SEQ ID NO: 6247
  Description of Artificial Sequence: Synthetic polypeptide
  VL of XENP018589

SEQ ID NO: 7190 - protein, 5 aa, Artificial Sequence
  Description of Artificial Sequence: Synthetic peptide
  XENP018589 vhCDR1
NYWMN

SEQ ID NO: 7191 - protein, 19 aa, Artificial Sequence
  Description of Artificial Sequence: Synthetic peptide
  XENP018589 vhCDR2
EIRLKANNYATHYAEPVKG

SEQ ID NO: 7192 - protein, 11 aa, Artificial Sequence
  Description of Artificial Sequence: Synthetic peptide
  XENP018589 vhCDR3
YYGNYGGYFDV

SEQ ID NO: 7193 - protein, 11 aa, Artificial Sequence
  Description of Artificial Sequence: Synthetic peptide
  XENP018589 vlCDR1
RASQSVSNDVA

SEQ ID NO: 7194 - protein, 7 aa, Artificial Sequence
  Description of Artificial Sequence: Synthetic peptide
  XENP018589 vlCDR2
YASHRYT

SEQ ID NO: 7195 - protein, 9 aa, Artificial Sequence
  Description of Artificial Sequence: Synthetic peptide
  XENP018589 vlCDR3
QQDYSSPRT

SEQ ID NO: 7196 - protein, 249 aa, Artificial Sequence
  Description of Artificial Sequence: Synthetic polypeptide
  XENP018590 1G6_H1.94_L1_scFv(GKPGS)4
EVQLVESGGGLVKPGGSLRLSCAASGFTFSNYWMNWVRQAPGKGLEWVGEIRLKQNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7197 - protein, 122 aa, Artificial Sequence
  Description of Artificial Sequence: Synthetic polypeptide
  VH of XENP018590
EVQLVESGGGLVKPGGSLRLSCAASGFTFSNYWMNWVRQAPGKGLEWVGEIRLKQNNYATHYAEPVKGRFTISRDDSKSTVYLQMNSLKTEDTAVYYCTRYYGNYGGYFDVWGAGTLVTVSS

SEQ ID NO: 7198 - protein, 107 aa, Artificial Sequence; identical to SEQ ID NO: 6247
  Description of Artificial Sequence: Synthetic polypeptide
  VL of XENP018590

SEQ ID NO: 7199 - protein, 5 aa, Artificial Sequence
  Description of Artificial Sequence: Synthetic peptide
  XENP018590 vhCDR1
NYWMN

SEQ ID NO: 7200 - protein, 19 aa, Artificial Sequence
  Description of Artificial Sequence: Synthetic peptide
  XENP018590 vhCDR2
EIRLKQNNYATHYAEPVKG

SEQ ID NO: 7201 - protein, 11 aa, Artificial Sequence
  Description of Artificial Sequence: Synthetic peptide
  XENP018590 vhCDR3
YYGNYGGYFDV

SEQ ID NO: 7202 - protein, 11 aa, Artificial Sequence
  Description of Artificial Sequence: Synthetic peptide
  XENP018590 vlCDR1
RASQSVSNDVA

SEQ ID NO: 7203 - protein, 7 aa, Artificial Sequence
  Description of Artificial Sequence: Synthetic peptide
  XENP018590 vlCDR2
YASHRYT

SEQ ID NO: 7204 - protein, 9 aa, Artificial Sequence
  Description of Artificial Sequence: Synthetic peptide
  XENP018590 vlCDR3
QQDYSSPRT

SEQ ID NO: 7205 - protein, 249 aa, Artificial Sequence
  Description of Artificial Sequence: Synthetic polypeptide
  XENP018591 1G6_H1.95_L1_scFv(GKPGS)4
EVQLVESGGGLVKPGGSLRLSCAASGFTFSNYWMNWVRQAPGKGLEWVGEIRLKGNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7206 - protein, 122 aa, Artificial Sequence
  Description of Artificial Sequence: Synthetic polypeptide
  VH of XENP018591
EVQLVESGGGLVKPGGSLRLSCAASGFTFSNYWMNWVRQAPGKGLEWVGEIRLKGNNYATHYAEPVKGRFTISRDDSKSTVYLQMNSLKTEDTAVYYCTRYYGNYGGYFDVWGAGTLVTVSS

SEQ ID NO: 7207 - protein, 107 aa, Artificial Sequence; identical to SEQ ID NO: 6247
  Description of Artificial Sequence: Synthetic polypeptide
  VL of XENP018591

SEQ ID NO: 7208 - protein, 5 aa, Artificial Sequence
  Description of Artificial Sequence: Synthetic peptide
  XENP018591 vhCDR1
NYWMN

SEQ ID NO: 7209 - protein, 19 aa, Artificial Sequence
  Description of Artificial Sequence: Synthetic peptide
  XENP018591 vhCDR2
EIRLKGNNYATHYAEPVKG

SEQ ID NO: 7210 - protein, 11 aa, Artificial Sequence
  Description of Artificial Sequence: Synthetic peptide
  XENP018591 vhCDR3
YYGNYGGYFDV

SEQ ID NO: 7211 - protein, 11 aa, Artificial Sequence
  Description of Artificial Sequence: Synthetic peptide
  XENP018591 vlCDR1
RASQSVSNDVA

SEQ ID NO: 7212 - protein, 7 aa, Artificial Sequence
  Description of Artificial Sequence: Synthetic peptide
  XENP018591 vlCDR2
YASHRYT

SEQ ID NO: 7213 - protein, 9 aa, Artificial Sequence
  Description of Artificial Sequence: Synthetic peptide
  XENP018591 vlCDR3
QQDYSSPRT

SEQ ID NO: 7214 - protein, 249 aa, Artificial Sequence
  Description of Artificial Sequence: Synthetic polypeptide
  XENP018592 1G6_H1.96_L1_scFv(GKPGS)4
EVQLVESGGGLVKPGGSLRLSCAASGFTFSNYWMNWVRQAPGKGLEWVGEIRLKVNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7215 - protein, 122 aa, Artificial Sequence
  Description of Artificial Sequence: Synthetic polypeptide
  VH of XENP018592
EVQLVESGGGLVKPGGSLRLSCAASGFTFSNYWMNWVRQAPGKGLEWVGEIRLKVNNYATHYAEPVKGRFTISRDDSKSTVYLQMNSLKTEDTAVYYCTRYYGNYGGYFDVWGAGTLVTVSS

SEQ ID NO: 7216 - protein, 107 aa, Artificial Sequence; identical to SEQ ID NO: 6247
  Description of Artificial Sequence: Synthetic polypeptide
  VL of XENP018592

SEQ ID NO: 7217 - protein, 5 aa, Artificial Sequence
  Description of Artificial Sequence: Synthetic peptide
  XENP018592 vhCDR1
NYWMN

SEQ ID NO: 7218 - protein, 19 aa, Artificial Sequence
  Description of Artificial Sequence: Synthetic peptide
  XENP018592 vhCDR2
EIRLKVNNYATHYAEPVKG

SEQ ID NO: 7219 - protein, 11 aa, Artificial Sequence
  Description of Artificial Sequence: Synthetic peptide
  XENP018592 vhCDR3
YYGNYGGYFDV

SEQ ID NO: 7220 - protein, 11 aa, Artificial Sequence
  Description of Artificial Sequence: Synthetic peptide
  XENP018592 vlCDR1
RASQSVSNDVA

SEQ ID NO: 7221 - protein, 7 aa, Artificial Sequence
  Description of Artificial Sequence: Synthetic peptide
  XENP018592 vlCDR2
YASHRYT

SEQ ID NO: 7222 - protein, 9 aa, Artificial Sequence
  Description of Artificial Sequence: Synthetic peptide
  XENP018592 vlCDR3
QQDYSSPRT

SEQ ID NO: 7223 - protein, 249 aa, Artificial Sequence
  Description of Artificial Sequence: Synthetic polypeptide
  XENP018593 1G6_H1.97_L1_scFv(GKPGS)4
EVQLVESGGGLVKPGGSLRLSCAASGFTFSNYWMNWVRQAPGKGLEWVGEIRLKHNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7224 - protein, 122 aa, Artificial Sequence
  Description of Artificial Sequence: Synthetic polypeptide
  VH of XENP018593
EVQLVESGGGLVKPGGSLRLSCAASGFTFSNYWMNWVRQAPGKGLEWVGEIRLKHNNYATHYAEPVKGRFTISRDDSKSTVYLQMNSLKTEDTAVYYCTRYYGNYGGYFDVWGAGTLVTVSS

SEQ ID NO: 7225 - protein, 107 aa, Artificial Sequence; identical to SEQ ID NO: 6247
  Description of Artificial Sequence: Synthetic polypeptide
  VL of XENP018593

SEQ ID NO: 7226 - protein, 5 aa, Artificial Sequence
  Description of Artificial Sequence: Synthetic peptide
  XENP018593 vhCDR1
NYWMN

SEQ ID NO: 7227 - protein, 19 aa, Artificial Sequence
  Description of Artificial Sequence: Synthetic peptide
  XENP018593 vhCDR2
EIRLKHNNYATHYAEPVKG

SEQ ID NO: 7228 - protein, 11 aa, Artificial Sequence
  Description of Artificial Sequence: Synthetic peptide
  XENP018593 vhCDR3
YYGNYGGYFDV

SEQ ID NO: 7229 - protein, 11 aa, Artificial Sequence
  Description of Artificial Sequence: Synthetic peptide
  XENP018593 vlCDR1
RASQSVSNDVA

SEQ ID NO: 7230 - protein, 7 aa, Artificial Sequence
  Description of Artificial Sequence: Synthetic peptide
  XENP018593 vlCDR2
YASHRYT

SEQ ID NO: 7231 - protein, 9 aa, Artificial Sequence
  Description of Artificial Sequence: Synthetic peptide
  XENP018593 vlCDR3
QQDYSSPRT

SEQ ID NO: 7232 - protein, 249 aa, Artificial Sequence
  Description of Artificial Sequence: Synthetic polypeptide
  XENP018594 1G6_H1.98_L1_scFv(GKPGS)4
EVQLVESGGGLVKPGGSLRLSCAASGFTFSNYWMNWVRQAPGKGLEWVGEIRLKDNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7233 - protein, 122 aa, Artificial Sequence
  Description of Artificial Sequence: Synthetic polypeptide
  VH of XENP018594
EVQLVESGGGLVKPGGSLRLSCAASGFTFSNYWMNWVRQAPGKGLEWVGEIRLKDNNYATHYAEPVKGRFTISRDDSKSTVYLQMNSLKTEDTAVYYCTRYYGNYGGYFDVWGAGTLVTVSS

SEQ ID NO: 7234 - protein, 107 aa, Artificial Sequence; identical to SEQ ID NO: 6247
  Description of Artificial Sequence: Synthetic polypeptide
  VL of XENP018594

SEQ ID NO: 7235 - protein, 5 aa, Artificial Sequence
  Description of Artificial Sequence: Synthetic peptide
  XENP018594 vhCDR1
NYWMN

SEQ ID NO: 7236 - protein, 19 aa, Artificial Sequence
  Description of Artificial Sequence: Synthetic peptide
  XENP018594 vhCDR2
EIRLKDNNYATHYAEPVKG

SEQ ID NO: 7237 - protein, 11 aa, Artificial Sequence
  Description of Artificial Sequence: Synthetic peptide
  XENP018594 vhCDR3
YYGNYGGYFDV

SEQ ID NO: 7238 - protein, 11 aa, Artificial Sequence
  Description of Artificial Sequence: Synthetic peptide
  XENP018594 vlCDR1
RASQSVSNDVA

SEQ ID NO: 7239 - protein, 7 aa, Artificial Sequence
  Description of Artificial Sequence: Synthetic peptide
  XENP018594 vlCDR2
YASHRYT

SEQ ID NO: 7240 - protein, 9 aa, Artificial Sequence
  Description of Artificial Sequence: Synthetic peptide
  XENP018594 vlCDR3
QQDYSSPRT

SEQ ID NO: 7241 - protein, 249 aa, Artificial Sequence
  Description of Artificial Sequence: Synthetic polypeptide
  XENP018595 1G6_H1.99_L1_scFv(GKPGS)4
EVQLVESGGGLVKPGGSLRLSCAASGFTFSNYWMNWVRQAPGKGLEWVGEIRLKKNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7242 - protein, 122 aa, Artificial Sequence
  Description of Artificial Sequence: Synthetic polypeptide
  VH of XENP018595
EVQLVESGGGLVKPGGSLRLSCAASGFTFSNYWMNWVRQAPGKGLEWVGEIRLKKNNYATHYAEPVKGRFTISRDDSKSTVYLQMNSLKTEDTAVYYCTRYYGNYGGYFDVWGAGTLVTVSS

SEQ ID NO: 7243 - protein, 107 aa, Artificial Sequence; identical to SEQ ID NO: 6247
  Description of Artificial Sequence: Synthetic polypeptide
  VL of XENP018595

SEQ ID NO: 7244 - protein, 5 aa, Artificial Sequence
  Description of Artificial Sequence: Synthetic peptide
  XENP018595 vhCDR1
NYWMN

SEQ ID NO: 7245 - protein, 19 aa, Artificial Sequence
  Description of Artificial Sequence: Synthetic peptide
  XENP018595 vhCDR2
EIRLKKNNYATHYAEPVKG

SEQ ID NO: 7246 - protein, 11 aa, Artificial Sequence
  Description of Artificial Sequence: Synthetic peptide
  XENP018595 vhCDR3
YYGNYGGYFDV

SEQ ID NO: 7247 - protein, 11 aa, Artificial Sequence
  Description of Artificial Sequence: Synthetic peptide
  XENP018595 vlCDR1
RASQSVSNDVA

SEQ ID NO: 7248 - protein, 7 aa, Artificial Sequence
  Description of Artificial Sequence: Synthetic peptide
  XENP018595 vlCDR2
YASHRYT

SEQ ID NO: 7249 - protein, 9 aa, Artificial Sequence
  Description of Artificial Sequence: Synthetic peptide
  XENP018595 vlCDR3
QQDYSSPRT

SEQ ID NO: 7250 - protein, 249 aa, Artificial Sequence
  Description of Artificial Sequence: Synthetic polypeptide
  XENP018596 1G6_H1.100_L1_scFv(GKPGS)4
EVQLVESGGGLVKPGGSLRLSCAASGFTFSNYWMNWVRQAPGKGLEWVGEIRLKYNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7251 - protein, 122 aa, Artificial Sequence
  Description of Artificial Sequence: Synthetic polypeptide
  VH of XENP018596
EVQLVESGGGLVKPGGSLRLSCAASGFTFSNYWMNWVRQAPGKGLEWVGEIRLKYNNYATHYAEPVKGRFTISRDDSKSTVYLQMNSLKTEDTAVYYCTRYYGNYGGYFDVWGAGTLVTVSS

SEQ ID NO: 7252 - protein, 107 aa, Artificial Sequence; identical to SEQ ID NO: 6247
  Description of Artificial Sequence: Synthetic polypeptide
  VL of XENP018596

SEQ ID NO: 7253 - protein, 5 aa, Artificial Sequence
  Description of Artificial Sequence: Synthetic peptide
  XENP018596 vhCDR1
NYWMN

SEQ ID NO: 7254 - protein, 19 aa, Artificial Sequence
  Description of Artificial Sequence: Synthetic peptide
  XENP018596 vhCDR2
EIRLKYNNYATHYAEPVKG

SEQ ID NO: 7255 - protein, 11 aa, Artificial Sequence
  Description of Artificial Sequence: Synthetic peptide
  XENP018596 vhCDR3
YYGNYGGYFDV

SEQ ID NO: 7256 - protein, 11 aa, Artificial Sequence
  Description of Artificial Sequence: Synthetic peptide
  XENP018596 vlCDR1
RASQSVSNDVA

SEQ ID NO: 7257 - protein, 7 aa, Artificial Sequence
  Description of Artificial Sequence: Synthetic peptide
  XENP018596 vlCDR2
YASHRYT

SEQ ID NO: 7258 - protein, 9 aa, Artificial Sequence
  Description of Artificial Sequence: Synthetic peptide
  XENP018596 vlCDR3
QQDYSSPRT

SEQ ID NO: 7259 - protein, 249 aa, Artificial Sequence
  Description of Artificial Sequence: Synthetic polypeptide
  XENP018601 1G6_H1.101_L1_scFv(GKPGS)4
EVQLVESGGGLVKPGGSLRLSCAASGFTFSNYWMNWVRQAPGKGLEWVGEIRLKSDNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7260 - protein, 122 aa, Artificial Sequence
  Description of Artificial Sequence: Synthetic polypeptide
  VH of XENP018601
EVQLVESGGGLVKPGGSLRLSCAASGFTFSNYWMNWVRQAPGKGLEWVGEIRLKSDNYATHYAEPVKGRFTISRDDSKSTVYLQMNSLKTEDTAVYYCTRYYGNYGGYFDVWGAGTLVTVSS

SEQ ID NO: 7261 - protein, 107 aa, Artificial Sequence; identical to SEQ ID NO: 6247
  Description of Artificial Sequence: Synthetic polypeptide
  VL of XENP018601

SEQ ID NO: 7262 - protein, 5 aa, Artificial Sequence
  Description of Artificial Sequence: Synthetic peptide
  XENP018601 vhCDR1
NYWMN

SEQ ID NO: 7263 - protein, 19 aa, Artificial Sequence
  Description of Artificial Sequence: Synthetic peptide
  XENP018601 vhCDR2
EIRLKSDNYATHYAEPVKG

SEQ ID NO: 7264 - protein, 11 aa, Artificial Sequence
  Description of Artificial Sequence: Synthetic peptide
  XENP018601 vhCDR3
YYGNYGGYFDV

SEQ ID NO: 7265 - protein, 11 aa, Artificial Sequence
  Description of Artificial Sequence: Synthetic peptide
  XENP018601 vlCDR1
RASQSVSNDVA

SEQ ID NO: 7266 - protein, 7 aa, Artificial Sequence
  Description of Artificial Sequence: Synthetic peptide
  XENP018601 vlCDR2
YASHRYT

SEQ ID NO: 7267 - protein, 9 aa, Artificial Sequence
  Description of Artificial Sequence: Synthetic peptide
  XENP018601 vlCDR3
QQDYSSPRT

SEQ ID NO: 7268 - protein, 249 aa, Artificial Sequence
  Description of Artificial Sequence: Synthetic polypeptide
  XENP018602 1G6_H1.102_L1_scFv(GKPGS)4
EVQLVESGGGLVKPGGSLRLSCAASGFTFSNYWMNWVRQAPGKGLEWVGEIRLKSHNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7269 - protein, 122 aa, Artificial Sequence
  Description of Artificial Sequence: Synthetic polypeptide
  VH of XENP018602
EVQLVESGGGLVKPGGSLRLSCAASGFTFSNYWMNWVRQAPGKGLEWVGEIRLKSHNYATHYAEPVKGRFTISRDDSKSTVYLQMNSLKTEDTAVYYCTRYYGNYGGYFDVWGAGTLVTVSS

SEQ ID NO: 7270 - protein, 107 aa, Artificial Sequence; identical to SEQ ID NO: 6247
  Description of Artificial Sequence: Synthetic polypeptide
  VL of XENP018602

SEQ ID NO: 7271 - protein, 5 aa, Artificial Sequence
  Description of Artificial Sequence: Synthetic peptide
  XENP018602 vhCDR1
NYWMN

SEQ ID NO: 7272 - protein, 19 aa, Artificial Sequence
  Description of Artificial Sequence: Synthetic peptide
  XENP018602 vhCDR2
EIRLKSHNYATHYAEPVKG

SEQ ID NO: 7273 - protein, 11 aa, Artificial Sequence
  Description of Artificial Sequence: Synthetic peptide
  XENP018602 vhCDR3
YYGNYGGYFDV

SEQ ID NO: 7274 - protein, 11 aa, Artificial Sequence
  Description of Artificial Sequence: Synthetic peptide
  XENP018602 vlCDR1
RASQSVSNDVA

SEQ ID NO: 7275 - protein, 7 aa, Artificial Sequence
  Description of Artificial Sequence: Synthetic peptide
  XENP018602 vlCDR2
YASHRYT

SEQ ID NO: 7276 - protein, 9 aa, Artificial Sequence
  Description of Artificial Sequence: Synthetic peptide
  XENP018602 vlCDR3
QQDYSSPRT

SEQ ID NO: 7277 - protein, 249 aa, Artificial Sequence
  Description of Artificial Sequence: Synthetic polypeptide
  XENP018603 1G6_H1.103_L1_scFv(GKPGS)4
EVQLVESGGGLVKPGGSLRLSCAASGFTFSNYWMNWVRQAPGKGLEWVGEIRLKSENYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7278 - protein, 122 aa, Artificial Sequence
  Description of Artificial Sequence: Synthetic polypeptide
  VH of XENP018603
EVQLVESGGGLVKPGGSLRLSCAASGFTFSNYWMNWVRQAPGKGLEWVGEIRLKSENYATHYAEPVKGRFTISRDDSKSTVYLQMNSLKTEDTAVYYCTRYYGNYGGYFDVWGAGTLVTVSS

SEQ ID NO: 7279 - protein, 107 aa, Artificial Sequence; identical to SEQ ID NO: 6247
  Description of Artificial Sequence: Synthetic polypeptide
  VL of XENP018603

SEQ ID NO: 7280 - protein, 5 aa, Artificial Sequence
  Description of Artificial Sequence: Synthetic peptide
  XENP018603 vhCDR1
NYWMN

SEQ ID NO: 7281 - protein, 19 aa, Artificial Sequence
  Description of Artificial Sequence: Synthetic peptide
  XENP018603 vhCDR2
EIRLKSENYATHYAEPVKG

SEQ ID NO: 7282 - protein, 11 aa, Artificial Sequence
  Description of Artificial Sequence: Synthetic peptide
  XENP018603 vhCDR3
YYGNYGGYFDV

SEQ ID NO: 7283 - protein, 11 aa, Artificial Sequence
  Description of Artificial Sequence: Synthetic peptide
  XENP018603 vlCDR1
RASQSVSNDVA

SEQ ID NO: 7284 - protein, 7 aa, Artificial Sequence
  Description of Artificial Sequence: Synthetic peptide
  XENP018603 vlCDR2
YASHRYT

SEQ ID NO: 7285 - protein, 9 aa, Artificial Sequence
  Description of Artificial Sequence: Synthetic peptide
  XENP018603 vlCDR3
QQDYSSPRT

SEQ ID NO: 7286 - protein, 249 aa, Artificial Sequence
  Description of Artificial Sequence: Synthetic polypeptide
  XENP018604 1G6_H1.104_L1_scFv(GKPGS)4
EVQLVESGGGLVKPGGSLRLSCAASGFTFSNYWMNWVRQAPGKGLEWVGEIRLKSSNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7287 - protein, 122 aa, Artificial Sequence
  Description of Artificial Sequence: Synthetic polypeptide
  VH of XENP018604
EVQLVESGGGLVKPGGSLRLSCAASGFTFSNYWMNWVRQAPGKGLEWVGEIRLKSSNYATHYAEPVKGRFTISRDDSKSTVYLQMNSLKTEDTAVYYCTRYYGNYGGYFDVWGAGTLVTVSS

SEQ ID NO: 7288 - protein, 107 aa, Artificial Sequence; identical to SEQ ID NO: 6247
  Description of Artificial Sequence: Synthetic polypeptide
  VL of XENP018604

SEQ ID NO: 7289 - protein, 5 aa, Artificial Sequence
  Description of Artificial Sequence: Synthetic peptide
  XENP018604 vhCDR1
NYWMN

SEQ ID NO: 7290 - protein, 19 aa, Artificial Sequence
  Description of Artificial Sequence: Synthetic peptide
  XENP018604 vhCDR2
EIRLKSSNYATHYAEPVKG

SEQ ID NO: 7291 - protein, 11 aa, Artificial Sequence
  Description of Artificial Sequence: Synthetic peptide
  XENP018604 vhCDR3
YYGNYGGYFDV

SEQ ID NO: 7292 - protein, 11 aa, Artificial Sequence
  Description of Artificial Sequence: Synthetic peptide
  XENP018604 vlCDR1
RASQSVSNDVA

SEQ ID NO: 7293 - protein, 7 aa, Artificial Sequence
  Description of Artificial Sequence: Synthetic peptide
  XENP018604 vlCDR2
YASHRYT

SEQ ID NO: 7294 - protein, 9 aa, Artificial Sequence
  Description of Artificial Sequence: Synthetic peptide
  XENP018604 vlCDR3
QQDYSSPRT

SEQ ID NO: 7295 - protein, 249 aa, Artificial Sequence
  Description of Artificial Sequence: Synthetic polypeptide
  XENP018605 1G6_H1.105_L1_scFv(GKPGS)4
EVQLVESGGGLVKPGGSLRLSCAASGFTFSNYWMNWVRQAPGKGLEWVGEIRLKSRNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7296 - protein, 122 aa, Artificial Sequence
  Description of Artificial Sequence: Synthetic polypeptide
  VH of XENP018605
EVQLVESGGGLVKPGGSLRLSCAASGFTFSNYWMNWVRQAPGKGLEWVGEIRLKSRNYATHYAEPVKGRFTISRDDSKSTVYLQMNSLKTEDTAVYYCTRYYGNYGGYFDVWGAGTLVTVSS

SEQ ID NO: 7297 - protein, 107 aa, Artificial Sequence; identical to SEQ ID NO: 6247
  Description of Artificial Sequence: Synthetic polypeptide
  VL of XENP018605

SEQ ID NO: 7298 - protein, 5 aa, Artificial Sequence
  Description of Artificial Sequence: Synthetic peptide
  XENP018605 vhCDR1
NYWMN

SEQ ID NO: 7299 - protein, 19 aa, Artificial Sequence
  Description of Artificial Sequence: Synthetic peptide
  XENP018605 vhCDR2
EIRLKSRNYATHYAEPVKG

SEQ ID NO: 7300 - protein, 11 aa, Artificial Sequence
  Description of Artificial Sequence: Synthetic peptide
  XENP018605 vhCDR3
YYGNYGGYFDV

SEQ ID NO: 7301 - protein, 11 aa, Artificial Sequence
  Description of Artificial Sequence: Synthetic peptide
  XENP018605 vlCDR1
RASQSVSNDVA

SEQ ID NO: 7302 - protein, 7 aa, Artificial Sequence
  Description of Artificial Sequence: Synthetic peptide
  XENP018605 vlCDR2
YASHRYT

SEQ ID NO: 7303 - protein, 9 aa, Artificial Sequence
  Description of Artificial Sequence: Synthetic peptide
  XENP018605 vlCDR3
QQDYSSPRT

SEQ ID NO: 7304 - protein, 249 aa, Artificial Sequence
  Description of Artificial Sequence: Synthetic polypeptide
  XENP018606 1G6_H1.106_L1_scFv(GKPGS)4
EVQLVESGGGLVKPGGSLRLSCAASGFTFSNYWMNWVRQAPGKGLEWVGEIRLKSLNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7305 - protein, 122 aa, Artificial Sequence
  Description of Artificial Sequence: Synthetic polypeptide
  VH of XENP018606
EVQLVESGGGLVKPGGSLRLSCAASGFTFSNYWMNWVRQAPGKGLEWVGEIRLKSLNYATHYAEPVKGRFTISRDDSKSTVYLQMNSLKTEDTAVYYCTRYYGNYGGYFDVWGAGTLVTVSS

SEQ ID NO: 7306 - protein, 107 aa, Artificial Sequence; identical to SEQ ID NO: 6247
  Description of Artificial Sequence: Synthetic polypeptide
  VL of XENP018606

SEQ ID NO: 7307 - protein, 5 aa, Artificial Sequence
  Description of Artificial Sequence: Synthetic peptide
  XENP018606 vhCDR1
NYWMN

SEQ ID NO: 7308 - protein, 19 aa, Artificial Sequence
  Description of Artificial Sequence: Synthetic peptide
  XENP018606 vhCDR2
EIRLKSLNYATHYAEPVKG

SEQ ID NO: 7309 - protein, 11 aa, Artificial Sequence
  Description of Artificial Sequence: Synthetic peptide
  XENP018606 vhCDR3
YYGNYGGYFDV

SEQ ID NO: 7310 - protein, 11 aa, Artificial Sequence
  Description of Artificial Sequence: Synthetic peptide
  XENP018606 vlCDR1
RASQSVSNDVA

SEQ ID NO: 7311 - protein, 7 aa, Artificial Sequence
  Description of Artificial Sequence: Synthetic peptide
  XENP018606 vlCDR2
YASHRYT

SEQ ID NO: 7312 - protein, 9 aa, Artificial Sequence
  Description of Artificial Sequence: Synthetic peptide
  XENP018606 vlCDR3
QQDYSSPRT

SEQ ID NO: 7313 - protein, 249 aa, Artificial Sequence
  Description of Artificial Sequence: Synthetic polypeptide
  XENP018607 1G6_H1.107_L1_scFv(GKPGS)4
EVQLVESGGGLVKPGGSLRLSCAASGFTFSNYWMNWVRQAPGKGLEWVGEIRLKSTNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7314 - protein, 122 aa, Artificial Sequence
  Description of Artificial Sequence: Synthetic polypeptide
  VH of XENP018607
EVQLVESGGGLVKPGGSLRLSCAASGFTFSNYWMNWVRQAPGKGLEWVGEIRLKSTNYATHYAEPVKGRFTISRDDSKSTVYLQMNSLKTEDTAVYYCTRYYGNYGGYFDVWGAGTLVTVSS

SEQ ID NO: 7315 - protein, 107 aa, Artificial Sequence; identical to SEQ ID NO: 6247
  Description of Artificial Sequence: Synthetic polypeptide
  VL of XENP018607

SEQ ID NO: 7316 - protein, 5 aa, Artificial Sequence
  Description of Artificial Sequence: Synthetic peptide
  XENP018607 vhCDR1
NYWMN

SEQ ID NO: 7317 - protein, 19 aa, Artificial Sequence
  Description of Artificial Sequence: Synthetic peptide
  XENP018607 vhCDR2
EIRLKSTNYATHYAEPVKG

SEQ ID NO: 7318 - protein, 11 aa, Artificial Sequence
  Description of Artificial Sequence: Synthetic peptide
  XENP018607 vhCDR3
YYGNYGGYFDV

SEQ ID NO: 7319 - protein, 11 aa, Artificial Sequence
  Description of Artificial Sequence: Synthetic peptide
  XENP018607 vlCDR1
RASQSVSNDVA

SEQ ID NO: 7320 - protein, 7 aa, Artificial Sequence
  Description of Artificial Sequence: Synthetic peptide
  XENP018607 vlCDR2
YASHRYT

SEQ ID NO: 7321 - protein, 9 aa, Artificial Sequence
  Description of Artificial Sequence: Synthetic peptide
  XENP018607 vlCDR3
QQDYSSPRT

SEQ ID NO: 7322 - protein, 249 aa, Artificial Sequence
  Description of Artificial Sequence: Synthetic polypeptide
  XENP018608 1G6_H1.108_L1_scFv(GKPGS)4
EVQLVESGGGLVKPGGSLRLSCAASGFTFSNYWMNWVRQAPGKGLEWVGEIRLKSGNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7323 - protein, 122 aa, Artificial Sequence
  Description of Artificial Sequence: Synthetic polypeptide
  VH of XENP018608
EVQLVESGGGLVKPGGSLRLSCAASGFTFSNYWMNWVRQAPGKGLEWVGEIRLKSGNYATHYAEPVKGRFTISRDDSKSTVYLQMNSLKTEDTAVYYCTRYYGNYGGYFDVWGAGTLVTVSS

SEQ ID NO: 7324 - protein, 107 aa, Artificial Sequence; identical to SEQ ID NO: 6247
  Description of Artificial Sequence: Synthetic polypeptide
  VL of XENP018608

SEQ ID NO: 7325 - protein, 5 aa, Artificial Sequence
  Description of Artificial Sequence: Synthetic peptide
  XENP018608 vhCDR1
NYWMN

SEQ ID NO: 7326 - protein, 19 aa, Artificial Sequence
  Description of Artificial Sequence: Synthetic peptide
  XENP018608 vhCDR2
EIRLKSGNYATHYAEPVKG

SEQ ID NO: 7327 - protein, 11 aa, Artificial Sequence
  Description of Artificial Sequence: Synthetic peptide
  XENP018608 vhCDR3
YYGNYGGYFDV

SEQ ID NO: 7328 - protein, 11 aa, Artificial Sequence
  Description of Artificial Sequence: Synthetic peptide
  XENP018608 vlCDR1
RASQSVSNDVA

SEQ ID NO: 7329 - protein, 7 aa, Artificial Sequence
  Description of Artificial Sequence: Synthetic peptide
  XENP018608 vlCDR2
YASHRYT

SEQ ID NO: 7330 - protein, 9 aa, Artificial Sequence
  Description of Artificial Sequence: Synthetic peptide
  XENP018608 vlCDR3
QQDYSSPRT

SEQ ID NO: 7331 - protein, 249 aa, Artificial Sequence
  Description of Artificial Sequence: Synthetic polypeptide
  XENP018609 1G6_H1.109_L1_scFv(GKPGS)4
EVQLVESGGGLVKPGGSLRLSCAASGFTFSNYWMNWVRQAPGKGLEWVGEIRLKSYNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7332 - protein, 122 aa, Artificial Sequence
  Description of Artificial Sequence: Synthetic polypeptide
  VH of XENP018609
EVQLVESGGGLVKPGGSLRLSCAASGFTFSNYWMNWVRQAPGKGLEWVGEIRLKSYNYATHYAEPVKGRFTISRDDSKSTVYLQMNSLKTEDTAVYYCTRYYGNYGGYFDVWGAGTLVTVSS

SEQ ID NO: 7333 - protein, 107 aa, Artificial Sequence; identical to SEQ ID NO: 6247
  Description of Artificial Sequence: Synthetic polypeptide
  VL of XENP018609

SEQ ID NO: 7334 - protein, 5 aa, Artificial Sequence
  Description of Artificial Sequence: Synthetic peptide
  XENP018609 vhCDR1
NYWMN

SEQ ID NO: 7335 - protein, 19 aa, Artificial Sequence
  Description of Artificial Sequence: Synthetic peptide
  XENP018609 vhCDR2
EIRLKSYNYATHYAEPVKG

SEQ ID NO: 7336 - protein, 11 aa, Artificial Sequence
  Description of Artificial Sequence: Synthetic peptide
  XENP018609 vhCDR3
YYGNYGGYFDV

SEQ ID NO: 7337 - protein, 11 aa, Artificial Sequence
  Description of Artificial Sequence: Synthetic peptide
  XENP018609 vlCDR1
RASQSVSNDVA

SEQ ID NO: 7338 - protein, 7 aa, Artificial Sequence
  Description of Artificial Sequence: Synthetic peptide
  XENP018609 vlCDR2
YASHRYT

SEQ ID NO: 7339 - protein, 9 aa, Artificial Sequence
  Description of Artificial Sequence: Synthetic peptide
  XENP018609 vlCDR3
QQDYSSPRT

SEQ ID NO: 7340 - protein, 249 aa, Artificial Sequence
  Description of Artificial Sequence: Synthetic polypeptide
  XENP018610 1G6_H1.110_L1_scFv(GKPGS)4
EVQLVESGGGLVKPGGSLRLSCAASGFTFSNYWMNWVRQAPGKGLEWVGEIRLKSNDYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7341 - protein, 122 aa, Artificial Sequence
  Description of Artificial Sequence: Synthetic polypeptide
  VH of XENP018610
EVQLVESGGGLVKPGGSLRLSCAASGFTFSNYWMNWVRQAPGKGLEWVGEIRLKSNDYATHYAEPVKGRFTISRDDSKSTVYLQMNSLKTEDTAVYYCTRYYGNYGGYFDVWGAGTLVTVSS

SEQ ID NO: 7342 - protein, 107 aa, Artificial Sequence; identical to SEQ ID NO: 6247
  Description of Artificial Sequence: Synthetic polypeptide
  VL of XENP018610

SEQ ID NO: 7343 - protein, 5 aa, Artificial Sequence
  Description of Artificial Sequence: Synthetic peptide
  XENP018610 vhCDR1
NYWMN

SEQ ID NO: 7344 - protein, 19 aa, Artificial Sequence
  Description of Artificial Sequence: Synthetic peptide
  XENP018610 vhCDR2
EIRLKSNDYATHYAEPVKG

SEQ ID NO: 7345 - protein, 11 aa, Artificial Sequence
  Description of Artificial Sequence: Synthetic peptide
  XENP018610 vhCDR3
YYGNYGGYFDV

SEQ ID NO: 7346 - protein, 11 aa, Artificial Sequence
  Description of Artificial Sequence: Synthetic peptide
  XENP018610 vlCDR1
RASQSVSNDVA

SEQ ID NO: 7347 - protein, 7 aa, Artificial Sequence
  Description of Artificial Sequence: Synthetic peptide
  XENP018610 vlCDR2
YASHRYT

SEQ ID NO: 7348 - protein, 9 aa, Artificial Sequence
  Description of Artificial Sequence: Synthetic peptide
  XENP018610 vlCDR3
QQDYSSPRT

SEQ ID NO: 7349 - protein, 249 aa, Artificial Sequence
  Description of Artificial Sequence: Synthetic polypeptide
  XENP018611 1G6_H1.111_L1_scFv(GKPGS)4
EVQLVESGGGLVKPGGSLRLSCAASGFTFSNYWMNWVRQAPGKGLEWVGEIRLKSNHYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7350 - protein, 122 aa, Artificial Sequence
  Description of Artificial Sequence: Synthetic polypeptide
  VH of XENP018611
EVQLVESGGGLVKPGGSLRLSCAASGFTFSNYWMNWVRQAPGKGLEWVGEIRLKSNHYATHYAEPVKGRFTISRDDSKSTVYLQMNSLKTEDTAVYYCTRYYGNYGGYFDVWGAGTLVTVSS

SEQ ID NO: 7351 - protein, 107 aa, Artificial Sequence; identical to SEQ ID NO: 6247
  Description of Artificial Sequence: Synthetic polypeptide
  VL of XENP018611

SEQ ID NO: 7352 - protein, 5 aa, Artificial Sequence
  Description of Artificial Sequence: Synthetic peptide
  XENP018611 vhCDR1
NYWMN

SEQ ID NO: 7353 - protein, 19 aa, Artificial Sequence
  Description of Artificial Sequence: Synthetic peptide
  XENP018611 vhCDR2
EIRLKSNHYATHYAEPVKG

SEQ ID NO: 7354 - protein, 11 aa, Artificial Sequence
  Description of Artificial Sequence: Synthetic peptide
  XENP018611 vhCDR3
YYGNYGGYFDV

SEQ ID NO: 7355 - protein, 11 aa, Artificial Sequence
  Description of Artificial Sequence: Synthetic peptide
  XENP018611 vlCDR1
RASQSVSNDVA

SEQ ID NO: 7356 - protein, 7 aa, Artificial Sequence
  Description of Artificial Sequence: Synthetic peptide
  XENP018611 vlCDR2
YASHRYT

SEQ ID NO: 7357 - protein, 9 aa, Artificial Sequence
  Description of Artificial Sequence: Synthetic peptide
  XENP018611 vlCDR3
QQDYSSPRT

SEQ ID NO: 7358 - protein, 249 aa, Artificial Sequence
  Description of Artificial Sequence: Synthetic polypeptide
  XENP018612 1G6_H1.112_L1_scFv(GKPGS)4
EVQLVESGGGLVKPGGSLRLSCAASGFTFSNYWMNWVRQAPGKGLEWVGEIRLKSNEYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7359 - protein, 122 aa, Artificial Sequence
  Description of Artificial Sequence: Synthetic polypeptide
  VH of XENP018612
EVQLVESGGGLVKPGGSLRLSCAASGFTFSNYWMNWVRQAPGKGLEWVGEIRLKSNEYATHYAEPVKGRFTISRDDSKSTVYLQMNSLKTEDTAVYYCTRYYGNYGGYFDVWGAGTLVTVSS

SEQ ID NO: 7360 - protein, 107 aa, Artificial Sequence; identical to SEQ ID NO: 6247
  Description of Artificial Sequence: Synthetic polypeptide
  VL of XENP018612

SEQ ID NO: 7361 - protein, 5 aa, Artificial Sequence
  Description of Artificial Sequence: Synthetic peptide
  XENP018612 vhCDR1
NYWMN

SEQ ID NO: 7362 - protein, 19 aa, Artificial Sequence
  Description of Artificial Sequence: Synthetic peptide
  XENP018612 vhCDR2
EIRLKSNEYATHYAEPVKG

SEQ ID NO: 7363 - protein, 11 aa, Artificial Sequence
  Description of Artificial Sequence: Synthetic peptide
  XENP018612 vhCDR3
YYGNYGGYFDV

SEQ ID NO: 7364 - protein, 11 aa, Artificial Sequence
  Description of Artificial Sequence: Synthetic peptide
  XENP018612 vlCDR1
RASQSVSNDVA

SEQ ID NO: 7365 - protein, 7 aa, Artificial Sequence
  Description of Artificial Sequence: Synthetic peptide
  XENP018612 vlCDR2
YASHRYT

SEQ ID NO: 7366 - protein, 9 aa, Artificial Sequence
  Description of Artificial Sequence: Synthetic peptide
  XENP018612 vlCDR3
QQDYSSPRT

SEQ ID NO: 7367 - protein, 249 aa, Artificial Sequence
  Description of Artificial Sequence: Synthetic polypeptide
  XENP018613 1G6_H1.113_L1_scFv(GKPGS)4
EVQLVESGGGLVKPGGSLRLSCAASGFTFSNYWMNWVRQAPGKGLEWVGEIRLKSNSYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7368 - protein, 122 aa, Artificial Sequence
  Description of Artificial Sequence: Synthetic polypeptide
  VH of XENP018613
EVQLVESGGGLVKPGGSLRLSCAASGFTFSNYWMNWVRQAPGKGLEWVGEIRLKSNSYATHYAEPVKGRFTISRDDSKSTVYLQMNSLKTEDTAVYYCTRYYGNYGGYFDVWGAGTLVTVSS

SEQ ID NO: 7369 - protein, 107 aa, Artificial Sequence; identical to SEQ ID NO: 6247
  Description of Artificial Sequence: Synthetic polypeptide
  VL of XENP018613

SEQ ID NO: 7370 - protein, 5 aa, Artificial Sequence
  Description of Artificial Sequence: Synthetic peptide
  XENP018613 vhCDR1
NYWMN

SEQ ID NO: 7371 - protein, 19 aa, Artificial Sequence
  Description of Artificial Sequence: Synthetic peptide
  XENP018613 vhCDR2
EIRLKSNSYATHYAEPVKG

SEQ ID NO: 7372 - protein, 11 aa, Artificial Sequence
  Description of Artificial Sequence: Synthetic peptide
  XENP018613 vhCDR3
YYGNYGGYFDV

SEQ ID NO: 7373 - protein, 11 aa, Artificial Sequence
  Description of Artificial Sequence: Synthetic peptide
  XENP018613 vlCDR1
RASQSVSNDVA

SEQ ID NO: 7374 - protein, 7 aa, Artificial Sequence
  Description of Artificial Sequence: Synthetic peptide
  XENP018613 vlCDR2
YASHRYT

SEQ ID NO: 7375 - protein, 9 aa, Artificial Sequence
  Description of Artificial Sequence: Synthetic peptide
  XENP018613 vlCDR3
QQDYSSPRT

SEQ ID NO: 7376 - protein, 249 aa, Artificial Sequence
  Description of Artificial Sequence: Synthetic polypeptide
  XENP018614 1G6_H1.114_L1_scFv(GKPGS)4
EVQLVESGGGLVKPGGSLRLSCAASGFTFSNYWMNWVRQAPGKGLEWVGEIRLKSNRYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7377 - protein, 122 aa, Artificial Sequence
  Description of Artificial Sequence: Synthetic polypeptide
  VH of XENP018614
EVQLVESGGGLVKPGGSLRLSCAASGFTFSNYWMNWVRQAPGKGLEWVGEIRLKSNRYATHYAEPVKGRFTISRDDSKSTVYLQMNSLKTEDTAVYYCTRYYGNYGGYFDVWGAGTLVTVSS

SEQ ID NO: 7378 - protein, 107 aa, Artificial Sequence; identical to SEQ ID NO: 6247
  Description of Artificial Sequence: Synthetic polypeptide
  VL of XENP018614

SEQ ID NO: 7379 - protein, 5 aa, Artificial Sequence
  Description of Artificial Sequence: Synthetic peptide
  XENP018614 vhCDR1
NYWMN

SEQ ID NO: 7380 - protein, 19 aa, Artificial Sequence
  Description of Artificial Sequence: Synthetic peptide
  XENP018614 vhCDR2
EIRLKSNRYATHYAEPVKG

SEQ ID NO: 7381 - protein, 11 aa, Artificial Sequence
  Description of Artificial Sequence: Synthetic peptide
  XENP018614 vhCDR3
YYGNYGGYFDV

SEQ ID NO: 7382 - protein, 11 aa, Artificial Sequence
  Description of Artificial Sequence: Synthetic peptide
  XENP018614 vlCDR1
RASQSVSNDVA

SEQ ID NO: 7383 - protein, 7 aa, Artificial Sequence
  Description of Artificial Sequence: Synthetic peptide
  XENP018614 vlCDR2
YASHRYT

SEQ ID NO: 7384 - protein, 9 aa, Artificial Sequence
  Description of Artificial Sequence: Synthetic peptide
  XENP018614 vlCDR3
QQDYSSPRT

SEQ ID NO: 7385 - protein, 249 aa, Artificial Sequence
  Description of Artificial Sequence: Synthetic polypeptide
  XENP018615 1G6_H1.115_L1_scFv(GKPGS)4
EVQLVESGGGLVKPGGSLRLSCAASGFTFSNYWMNWVRQAPGKGLEWVGEIRLKSNLYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7386 - protein, 122 aa, Artificial Sequence
  Description of Artificial Sequence: Synthetic polypeptide
  VH of XENP018615
EVQLVESGGGLVKPGGSLRLSCAASGFTFSNYWMNWVRQAPGKGLEWVGEIRLKSNLYATHYAEPVKGRFTISRDDSKSTVYLQMNSLKTEDTAVYYCTRYYGNYGGYFDVWGAGTLVTVSS

SEQ ID NO: 7387 - protein, 107 aa, Artificial Sequence; identical to SEQ ID NO: 6247
  Description of Artificial Sequence: Synthetic polypeptide
  VL of XENP018615

SEQ ID NO: 7388 - protein, 5 aa, Artificial Sequence
  Description of Artificial Sequence: Synthetic peptide
  XENP018615 vhCDR1
NYWMN

SEQ ID NO: 7389 - protein, 19 aa, Artificial Sequence
  Description of Artificial Sequence: Synthetic peptide
  XENP018615 vhCDR2
EIRLKSNLYATHYAEPVKG

SEQ ID NO: 7390 - protein, 11 aa, Artificial Sequence
  Description of Artificial Sequence: Synthetic peptide
  XENP018615 vhCDR3
YYGNYGGYFDV

SEQ ID NO: 7391 - protein, 11 aa, Artificial Sequence
  Description of Artificial Sequence: Synthetic peptide
  XENP018615 vlCDR1
RASQSVSNDVA

SEQ ID NO: 7392 - protein, 7 aa, Artificial Sequence
  Description of Artificial Sequence: Synthetic peptide
  XENP018615 vlCDR2
YASHRYT

SEQ ID NO: 7393 - protein, 9 aa, Artificial Sequence
  Description of Artificial Sequence: Synthetic peptide
  XENP018615 vlCDR3
QQDYSSPRT

SEQ ID NO: 7394 - protein, 249 aa, Artificial Sequence
  Description of Artificial Sequence: Synthetic polypeptide
  XENP018616 1G6_H1.116_L1_scFv(GKPGS)4
EVQLVESGGGLVKPGGSLRLSCAASGFTFSNYWMNWVRQAPGKGLEWVGEIRLKSNTYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7395 - protein, 122 aa, Artificial Sequence
  Description of Artificial Sequence: Synthetic polypeptide
  VH of XENP018616
EVQLVESGGGLVKPGGSLRLSCAASGFTFSNYWMNWVRQAPGKGLEWVGEIRLKSNTYATHYAEPVKGRFTISRDDSKSTVYLQMNSLKTEDTAVYYCTRYYGNYGGYFDVWGAGTLVTVSS

SEQ ID NO: 7396 - protein, 107 aa, Artificial Sequence; identical to SEQ ID NO: 6247
  Description of Artificial Sequence: Synthetic polypeptide
  VL of XENP018616

SEQ ID NO: 7397 - protein, 5 aa, Artificial Sequence
  Description of Artificial Sequence: Synthetic peptide
  XENP018616 vhCDR1
NYWMN

SEQ ID NO: 7398 - protein, 19 aa, Artificial Sequence
  Description of Artificial Sequence: Synthetic peptide
  XENP018616 vhCDR2
EIRLKSNTYATHYAEPVKG

SEQ ID NO: 7399 - protein, 11 aa, Artificial Sequence
  Description of Artificial Sequence: Synthetic peptide
  XENP018616 vhCDR3
YYGNYGGYFDV

SEQ ID NO: 7400 - protein, 11 aa, Artificial Sequence
  Description of Artificial Sequence: Synthetic peptide
  XENP018616 vlCDR1
RASQSVSNDVA

SEQ ID NO: 7401 - protein, 7 aa, Artificial Sequence
  Description of Artificial Sequence: Synthetic peptide
  XENP018616 vlCDR2
YASHRYT

SEQ ID NO: 7402 - protein, 9 aa, Artificial Sequence
  Description of Artificial Sequence: Synthetic peptide
  XENP018616 vlCDR3
QQDYSSPRT

SEQ ID NO: 7403 - protein, 249 aa, Artificial Sequence
  Description of Artificial Sequence: Synthetic polypeptide
  XENP018617 1G6_H1.117_L1_scFv(GKPGS)4
EVQLVESGGGLVKPGGSLRLSCAASGFTFSNYWMNWVRQAPGKGLEWVGEIRLKSNGYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7404 - protein, 122 aa, Artificial Sequence
  Description of Artificial Sequence: Synthetic polypeptide
  VH of XENP018617
EVQLVESGGGLVKPGGSLRLSCAASGFTFSNYWMNWVRQAPGKGLEWVGEIRLKSNGYATHYAEPVKGRFTISRDDSKSTVYLQMNSLKTEDTAVYYCTRYYGNYGGYFDVWGAGTLVTVSS

SEQ ID NO: 7405 - protein, 107 aa, Artificial Sequence; identical to SEQ ID NO: 6247
  Description of Artificial Sequence: Synthetic polypeptide
  VL of XENP018617

SEQ ID NO: 7406 - protein, 5 aa, Artificial Sequence
  Description of Artificial Sequence: Synthetic peptide
  XENP018617 vhCDR1
NYWMN

SEQ ID NO: 7407 - protein, 19 aa, Artificial Sequence
  Description of Artificial Sequence: Synthetic peptide
  XENP018617 vhCDR2
EIRLKSNGYATHYAEPVKG

SEQ ID NO: 7408 - protein, 11 aa, Artificial Sequence
  Description of Artificial Sequence: Synthetic peptide
  XENP018617 vhCDR3
YYGNYGGYFDV

SEQ ID NO: 7409 - protein, 11 aa, Artificial Sequence
  Description of Artificial Sequence: Synthetic peptide
  XENP018617 vlCDR1
RASQSVSNDVA

SEQ ID NO: 7410 - protein, 7 aa, Artificial Sequence
  Description of Artificial Sequence: Synthetic peptide
  XENP018617 vlCDR2
YASHRYT

SEQ ID NO: 7411 - protein, 9 aa, Artificial Sequence
  Description of Artificial Sequence: Synthetic peptide
  XENP018617 vlCDR3
QQDYSSPRT

SEQ ID NO: 7412 - protein, 249 aa, Artificial Sequence
  Description of Artificial Sequence: Synthetic polypeptide
  XENP018618 1G6_H1.118_L1_scFv(GKPGS)4
EVQLVESGGGLVKPGGSLRLSCAASGFTFSNYWMNWVRQAPGKGLEWVGEIRLKSNYYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7413 - protein, 122 aa, Artificial Sequence
  Description of Artificial Sequence: Synthetic polypeptide
  VH of XENP018618
EVQLVESGGGLVKPGGSLRLSCAASGFTFSNYWMNWVRQAPGKGLEWVGEIRLKSNYYATHYAEPVKGRFTISRDDSKSTVYLQMNSLKTEDTAVYYCTRYYGNYGGYFDVWGAGTLVTVSS

SEQ ID NO: 7414 - protein, 107 aa, Artificial Sequence; identical to SEQ ID NO: 6247
  Description of Artificial Sequence: Synthetic polypeptide
  VL of XENP018618

SEQ ID NO: 7415 - protein, 5 aa, Artificial Sequence
  Description of Artificial Sequence: Synthetic peptide
  XENP018618 vhCDR1
NYWMN

SEQ ID NO: 7416 - protein, 19 aa, Artificial Sequence
  Description of Artificial Sequence: Synthetic peptide
  XENP018618 vhCDR2
EIRLKSNYYATHYAEPVKG

SEQ ID NO: 7417 - protein, 11 aa, Artificial Sequence
  Description of Artificial Sequence: Synthetic peptide
  XENP018618 vhCDR3
YYGNYGGYFDV

SEQ ID NO: 7418 - protein, 11 aa, Artificial Sequence
  Description of Artificial Sequence: Synthetic peptide
  XENP018618 vlCDR1
RASQSVSNDVA

SEQ ID NO: 7419 - protein, 7 aa, Artificial Sequence
  Description of Artificial Sequence: Synthetic peptide
  XENP018618 vlCDR2
YASHRYT

SEQ ID NO: 7420 - protein, 9 aa, Artificial Sequence
  Description of Artificial Sequence: Synthetic peptide
  XENP018618 vlCDR3
QQDYSSPRT

SEQ ID NO: 7421 - protein, 249 aa, Artificial Sequence
  Description of Artificial Sequence: Synthetic polypeptide
  XENP018619 1G6_H1.119_L1_scFv(GKPGS)4
EVQLVESGGGLVKPGGSLRLSCAASGFTFSNYWMNWVRQAPGKGLEWVGEIRLKSNNFATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7422 - protein, 122 aa, Artificial Sequence
  Description of Artificial Sequence: Synthetic polypeptide
  VH of XENP018619
EVQLVESGGGLVKPGGSLRLSCAASGFTFSNYWMNWVRQAPGKGLEWVGEIRLKSNNFATHYAEPVKGRFTISRDDSKSTVYLQMNSLKTEDTAVYYCTRYYGNYGGYFDVWGAGTLVTVSS

SEQ ID NO: 7423 - protein, 107 aa, Artificial Sequence; identical to SEQ ID NO: 6247
  Description of Artificial Sequence: Synthetic polypeptide
  VL of XENP018619

SEQ ID NO: 7424 - protein, 5 aa, Artificial Sequence
  Description of Artificial Sequence: Synthetic peptide
  XENP018619 vhCDR1
NYWMN

SEQ ID NO: 7425 - protein, 19 aa, Artificial Sequence
  Description of Artificial Sequence: Synthetic peptide
  XENP018619 vhCDR2
EIRLKSNNFATHYAEPVKG

SEQ ID NO: 7426 - protein, 11 aa, Artificial Sequence
  Description of Artificial Sequence: Synthetic peptide
  XENP018619 vhCDR3
YYGNYGGYFDV

SEQ ID NO: 7427 - protein, 11 aa, Artificial Sequence
  Description of Artificial Sequence: Synthetic peptide
  XENP018619 vlCDR1
RASQSVSNDVA

SEQ ID NO: 7428 - protein, 7 aa, Artificial Sequence
  Description of Artificial Sequence: Synthetic peptide
  XENP018619 vlCDR2
YASHRYT

SEQ ID NO: 7429 - protein, 9 aa, Artificial Sequence
  Description of Artificial Sequence: Synthetic peptide
  XENP018619 vlCDR3
QQDYSSPRT

SEQ ID NO: 7430 - protein, 249 aa, Artificial Sequence
  Description of Artificial Sequence: Synthetic polypeptide
  XENP018620 1G6_H1.120_L1_scFv(GKPGS)4
EVQLVESGGGLVKPGGSLRLSCAASGFTFSNYWMNWVRQAPGKGLEWVGEIRLKSNNHATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7431 - protein, 122 aa, Artificial Sequence
  Description of Artificial Sequence: Synthetic polypeptide
  VH of XENP018620
EVQLVESGGGLVKPGGSLRLSCAASGFTFSNYWMNWVRQAPGKGLEWVGEIRLKSNNHATHYAEPVKGRFTISRDDSKSTVYLQMNSLKTEDTAVYYCTRYYGNYGGYFDVWGAGTLVTVSS

SEQ ID NO: 7432 - protein, 107 aa, Artificial Sequence; identical to SEQ ID NO: 6247
  Description of Artificial Sequence: Synthetic polypeptide
  VL of XENP018620

SEQ ID NO: 7433 - protein, 5 aa, Artificial Sequence
  Description of Artificial Sequence: Synthetic peptide
  XENP018620 vhCDR1
NYWMN

SEQ ID NO: 7434 - protein, 19 aa, Artificial Sequence
  Description of Artificial Sequence: Synthetic peptide
  XENP018620 vhCDR2
EIRLKSNNHATHYAEPVKG

SEQ ID NO: 7435 - protein, 11 aa, Artificial Sequence
  Description of Artificial Sequence: Synthetic peptide
  XENP018620 vhCDR3
YYGNYGGYFDV

SEQ ID NO: 7436 - protein, 11 aa, Artificial Sequence
  Description of Artificial Sequence: Synthetic peptide
  XENP018620 vlCDR1
RASQSVSNDVA

SEQ ID NO: 7437 - protein, 7 aa, Artificial Sequence
  Description of Artificial Sequence: Synthetic peptide
  XENP018620 vlCDR2
YASHRYT

SEQ ID NO: 7438 - protein, 9 aa, Artificial Sequence
  Description of Artificial Sequence: Synthetic peptide
  XENP018620 vlCDR3
QQDYSSPRT

SEQ ID NO: 7439 - protein, 249 aa, Artificial Sequence
  Description of Artificial Sequence: Synthetic polypeptide
  XENP018621 1G6_H1.121_L1_scFv(GKPGS)4
EVQLVESGGGLVKPGGSLRLSCAASGFTFSNYWMNWVRQAPGKGLEWVGEIRLKSNNLATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7440 - protein, 122 aa, Artificial Sequence
  Description of Artificial Sequence: Synthetic polypeptide
  VH of XENP018621
EVQLVESGGGLVKPGGSLRLSCAASGFTFSNYWMNWVRQAPGKGLEWVGEIRLKSNNLATHYAEPVKGRFTISRDDSKSTVYLQMNSLKTEDTAVYYCTRYYGNYGGYFDVWGAGTLVTVSS

SEQ ID NO: 7441 - protein, 107 aa, Artificial Sequence; identical to SEQ ID NO: 6247
  Description of Artificial Sequence: Synthetic polypeptide
  VL of XENP018621

SEQ ID NO: 7442 - protein, 5 aa, Artificial Sequence
  Description of Artificial Sequence: Synthetic peptide
  XENP018621 vhCDR1
NYWMN

SEQ ID NO: 7443 - protein, 19 aa, Artificial Sequence
  Description of Artificial Sequence: Synthetic peptide
  XENP018621 vhCDR2
EIRLKSNNLATHYAEPVKG

SEQ ID NO: 7444 - protein, 11 aa, Artificial Sequence
  Description of Artificial Sequence: Synthetic peptide
  XENP018621 vhCDR3
YYGNYGGYFDV

SEQ ID NO: 7445 - protein, 11 aa, Artificial Sequence
  Description of Artificial Sequence: Synthetic peptide
  XENP018621 vlCDR1
RASQSVSNDVA

SEQ ID NO: 7446 - protein, 7 aa, Artificial Sequence
  Description of Artificial Sequence: Synthetic peptide
  XENP018621 vlCDR2
YASHRYT

SEQ ID NO: 7447 - protein, 9 aa, Artificial Sequence
  Description of Artificial Sequence: Synthetic peptide
  XENP018621 vlCDR3
QQDYSSPRT

SEQ ID NO: 7448 - protein, 249 aa, Artificial Sequence
  Description of Artificial Sequence: Synthetic polypeptide
  XENP018622 1G6_H1.122_L1_scFv(GKPGS)4
EVQLVESGGGLVKPGGSLRLSCAASGFTFSNYWMNWVRQAPGKGLEWVGEIRLKSNNWATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7449 - protein, 122 aa, Artificial Sequence
  Description of Artificial Sequence: Synthetic polypeptide
  VH of XENP018622
EVQLVESGGGLVKPGGSLRLSCAASGFTFSNYWMNWVRQAPGKGLEWVGEIRLKSNNWATHYAEPVKGRFTISRDDSKSTVYLQMNSLKTEDTAVYYCTRYYGNYGGYFDVWGAGTLVTVSS

SEQ ID NO: 7450 - protein, 107 aa, Artificial Sequence; identical to SEQ ID NO: 6247
  Description of Artificial Sequence: Synthetic polypeptide
  VL of XENP018622

SEQ ID NO: 7451 - protein, 5 aa, Artificial Sequence
  Description of Artificial Sequence: Synthetic peptide
  XENP018622 vhCDR1
NYWMN

SEQ ID NO: 7452 - protein, 19 aa, Artificial Sequence
  Description of Artificial Sequence: Synthetic peptide
  XENP018622 vhCDR2
EIRLKSNNWATHYAEPVKG

SEQ ID NO: 7453 - protein, 11 aa, Artificial Sequence
  Description of Artificial Sequence: Synthetic peptide
  XENP018622 vhCDR3
YYGNYGGYFDV

SEQ ID NO: 7454 - protein, 11 aa, Artificial Sequence
  Description of Artificial Sequence: Synthetic peptide
  XENP018622 vlCDR1
RASQSVSNDVA

SEQ ID NO: 7455 - protein, 7 aa, Artificial Sequence
  Description of Artificial Sequence: Synthetic peptide
  XENP018622 vlCDR2
YASHRYT

SEQ ID NO: 7456 - protein, 9 aa, Artificial Sequence
  Description of Artificial Sequence: Synthetic peptide
  XENP018622 vlCDR3
QQDYSSPRT

SEQ ID NO: 7457 - protein, 249 aa, Artificial Sequence
  Description of Artificial Sequence: Synthetic polypeptide
  XENP018623 1G6_H1.123_L1_scFv(GKPGS)4
EVQLVESGGGLVKPGGSLRLSCAASGFTFSNYWMNWVRQAPGKGLEWVGEIRLKSNNVATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7458 - protein, 122 aa, Artificial Sequence
  Description of Artificial Sequence: Synthetic polypeptide
  VH of XENP018623
EVQLVESGGGLVKPGGSLRLSCAASGFTFSNYWMNWVRQAPGKGLEWVGEIRLKSNNVATHYAEPVKGRFTISRDDSKSTVYLQMNSLKTEDTAVYYCTRYYGNYGGYFDVWGAGTLVTVSS

SEQ ID NO: 7459 - protein, 107 aa, Artificial Sequence; identical to SEQ ID NO: 6247
  Description of Artificial Sequence: Synthetic polypeptide
  VL of XENP018623

SEQ ID NO: 7460 - protein, 5 aa, Artificial Sequence
  Description of Artificial Sequence: Synthetic peptide
  XENP018623 vhCDR1
NYWMN

SEQ ID NO: 7461 - protein, 19 aa, Artificial Sequence
  Description of Artificial Sequence: Synthetic peptide
  XENP018623 vhCDR2
EIRLKSNNVATHYAEPVKG

SEQ ID NO: 7462 - protein, 11 aa, Artificial Sequence
  Description of Artificial Sequence: Synthetic peptide
  XENP018623 vhCDR3
YYGNYGGYFDV

SEQ ID NO: 7463 - protein, 11 aa, Artificial Sequence
  Description of Artificial Sequence: Synthetic peptide
  XENP018623 vlCDR1
RASQSVSNDVA

SEQ ID NO: 7464 - protein, 7 aa, Artificial Sequence
  Description of Artificial Sequence: Synthetic peptide
  XENP018623 vlCDR2
YASHRYT

SEQ ID NO: 7465 - protein, 9 aa, Artificial Sequence
  Description of Artificial Sequence: Synthetic peptide
  XENP018623 vlCDR3
QQDYSSPRT

SEQ ID NO: 7466 - protein, 249 aa, Artificial Sequence
  Description of Artificial Sequence: Synthetic polypeptide
  XENP018624 1G6_H1.124_L1_scFv(GKPGS)4
EVQLVESGGGLVKPGGSLRLSCAASGFTFSNYWMNWVRQAPGKGLEWVGEIRLKSNNAATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7467 - protein, 122 aa, Artificial Sequence
  Description of Artificial Sequence: Synthetic polypeptide
  VH of XENP018624
EVQLVESGGGLVKPGGSLRLSCAASGFTFSNYWMNWVRQAPGKGLEWVGEIRLKSNNAATHYAEPVKGRFTISRDDSKSTVYLQMNSLKTEDTAVYYCTRYYGNYGGYFDVWGAGTLVTVSS

SEQ ID NO: 7468 - protein, 107 aa, Artificial Sequence; identical to SEQ ID NO: 6247
  Description of Artificial Sequence: Synthetic polypeptide
  VL of XENP018624

SEQ ID NO: 7469 - protein, 5 aa, Artificial Sequence
  Description of Artificial Sequence: Synthetic peptide
  XENP018624 vhCDR1
NYWMN

SEQ ID NO: 7470 - protein, 19 aa, Artificial Sequence
  Description of Artificial Sequence: Synthetic peptide
  XENP018624 vhCDR2
EIRLKSNNAATHYAEPVKG

SEQ ID NO: 7471 - protein, 11 aa, Artificial Sequence
  Description of Artificial Sequence: Synthetic peptide
  XENP018624 vhCDR3
YYGNYGGYFDV

SEQ ID NO: 7472 - protein, 11 aa, Artificial Sequence
  Description of Artificial Sequence: Synthetic peptide
  XENP018624 vlCDR1
RASQSVSNDVA

SEQ ID NO: 7473 - protein, 7 aa, Artificial Sequence
  Description of Artificial Sequence: Synthetic peptide
  XENP018624 vlCDR2
YASHRYT

SEQ ID NO: 7474 - protein, 9 aa, Artificial Sequence
  Description of Artificial Sequence: Synthetic peptide
  XENP018624 vlCDR3
QQDYSSPRT

SEQ ID NO: 7475 - protein, 249 aa, Artificial Sequence
  Description of Artificial Sequence: Synthetic polypeptide
  XENP018625 1G6_H1.125_L1_scFv(GKPGS)4
EVQLVESGGGLVKPGGSLRLSCAASGFTFSNYWMNWVRQAPGKGLEWVGEIRLKSNNQATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7476 - protein, 122 aa, Artificial Sequence
  Description of Artificial Sequence: Synthetic polypeptide
  VH of XENP018625
EVQLVESGGGLVKPGGSLRLSCAASGFTFSNYWMNWVRQAPGKGLEWVGEIRLKSNNQATHYAEPVKGRFTISRDDSKSTVYLQMNSLKTEDTAVYYCTRYYGNYGGYFDVWGAGTLVTVSS

SEQ ID NO: 7477 - protein, 107 aa, Artificial Sequence; identical to SEQ ID NO: 6247
  Description of Artificial Sequence: Synthetic polypeptide
  VL of XENP018625

SEQ ID NO: 7478 - protein, 5 aa, Artificial Sequence
  Description of Artificial Sequence: Synthetic peptide
  XENP018625 vhCDR1
NYWMN

SEQ ID NO: 7479 - protein, 19 aa, Artificial Sequence
  Description of Artificial Sequence: Synthetic peptide
  XENP018625 vhCDR2
EIRLKSNNQATHYAEPVKG

SEQ ID NO: 7480 - protein, 11 aa, Artificial Sequence
  Description of Artificial Sequence: Synthetic peptide
  XENP018625 vhCDR3
YYGNYGGYFDV

SEQ ID NO: 7481 - protein, 11 aa, Artificial Sequence
  Description of Artificial Sequence: Synthetic peptide
  XENP018625 vlCDR1
RASQSVSNDVA

SEQ ID NO: 7482 - protein, 7 aa, Artificial Sequence
  Description of Artificial Sequence: Synthetic peptide
  XENP018625 vlCDR2
YASHRYT

SEQ ID NO: 7483 - protein, 9 aa, Artificial Sequence
  Description of Artificial Sequence: Synthetic peptide
  XENP018625 vlCDR3
QQDYSSPRT

SEQ ID NO: 7484 - protein, 249 aa, Artificial Sequence
  Description of Artificial Sequence: Synthetic polypeptide
  XENP018626 1G6_H1.126_L1_scFv(GKPGS)4
EVQLVESGGGLVKPGGSLRLSCAASGFTFSNYWMNWVRQAPGKGLEWVGEIRLKSNNDATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7485 - protein, 122 aa, Artificial Sequence
  Description of Artificial Sequence: Synthetic polypeptide
  VH of XENP018626
EVQLVESGGGLVKPGGSLRLSCAASGFTFSNYWMNWVRQAPGKGLEWVGEIRLKSNNDATHYAEPVKGRFTISRDDSKSTVYLQMNSLKTEDTAVYYCTRYYGNYGGYFDVWGAGTLVTVSS

SEQ ID NO: 7486 - protein, 107 aa, Artificial Sequence; identical to SEQ ID NO: 6247
  Description of Artificial Sequence: Synthetic polypeptide
  VL of XENP018626

SEQ ID NO: 7487 - protein, 5 aa, Artificial Sequence
  Description of Artificial Sequence: Synthetic peptide
  XENP018626 vhCDR1
NYWMN

SEQ ID NO: 7488 - protein, 19 aa, Artificial Sequence
  Description of Artificial Sequence: Synthetic peptide
  XENP018626 vhCDR2
EIRLKSNNDATHYAEPVKG

SEQ ID NO: 7489 - protein, 11 aa, Artificial Sequence
  Description of Artificial Sequence: Synthetic peptide
  XENP018626 vhCDR3
YYGNYGGYFDV

SEQ ID NO: 7490 - protein, 11 aa, Artificial Sequence
  Description of Artificial Sequence: Synthetic peptide
  XENP018626 vlCDR1
RASQSVSNDVA

SEQ ID NO: 7491 - protein, 7 aa, Artificial Sequence
  Description of Artificial Sequence: Synthetic peptide
  XENP018626 vlCDR2
YASHRYT

SEQ ID NO: 7492 - protein, 9 aa, Artificial Sequence
  Description of Artificial Sequence: Synthetic peptide
  XENP018626 vlCDR3
QQDYSSPRT

SEQ ID NO: 7493 - protein, 249 aa, Artificial Sequence
  Description of Artificial Sequence: Synthetic polypeptide
  XENP018627 1G6_H1.127_L1_scFv(GKPGS)4
EVQLVESGGGLVKPGGSLRLSCAASGFTFSNYWMNWVRQAPGKGLEWVGEIRLKSNNKATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7494 - protein, 122 aa, Artificial Sequence
  Description of Artificial Sequence: Synthetic polypeptide
  VH of XENP018627
EVQLVESGGGLVKPGGSLRLSCAASGFTFSNYWMNWVRQAPGKGLEWVGEIRLKSNNKATHYAEPVKGRFTISRDDSKSTVYLQMNSLKTEDTAVYYCTRYYGNYGGYFDVWGAGTLVTVSS

SEQ ID NO: 7495 - protein, 107 aa, Artificial Sequence; identical to SEQ ID NO: 6247
  Description of Artificial Sequence: Synthetic polypeptide
  VL of XENP018627

SEQ ID NO: 7496 - protein, 5 aa, Artificial Sequence
  Description of Artificial Sequence: Synthetic peptide
  XENP018627 vhCDR1
NYWMN

SEQ ID NO: 7497 - protein, 19 aa, Artificial Sequence
  Description of Artificial Sequence: Synthetic peptide
  XENP018627 vhCDR2
EIRLKSNNKATHYAEPVKG

SEQ ID NO: 7498 - protein, 11 aa, Artificial Sequence
  Description of Artificial Sequence: Synthetic peptide
  XENP018627 vhCDR3
YYGNYGGYFDV

SEQ ID NO: 7499 - protein, 11 aa, Artificial Sequence
  Description of Artificial Sequence: Synthetic peptide
  XENP018627 vlCDR1
RASQSVSNDVA

SEQ ID NO: 7500 - protein, 7 aa, Artificial Sequence
  Description of Artificial Sequence: Synthetic peptide
  XENP018627 vlCDR2
YASHRYT

SEQ ID NO: 7501 - protein, 9 aa, Artificial Sequence
  Description of Artificial Sequence: Synthetic peptide
  XENP018627 vlCDR3
QQDYSSPRT

SEQ ID NO: 7502 - protein, 249 aa, Artificial Sequence
  Description of Artificial Sequence: Synthetic polypeptide
  XENP018628 1G6_H1.128_L1_scFv(GKPGS)4
EVQLVESGGGLVKPGGSLRLSCAASGFTFSNYWMNWVRQAPGKGLEWVGEIRLKSNNYGTHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7503 - protein, 122 aa, Artificial Sequence
  Description of Artificial Sequence: Synthetic polypeptide
  VH of XENP018628
EVQLVESGGGLVKPGGSLRLSCAASGFTFSNYWMNWVRQAPGKGLEWVGEIRLKSNNYGTHYAEPVKGRFTISRDDSKSTVYLQMNSLKTEDTAVYYCTRYYGNYGGYFDVWGAGTLVTVSS

SEQ ID NO: 7504 - protein, 107 aa, Artificial Sequence; identical to SEQ ID NO: 6247
  Description of Artificial Sequence: Synthetic polypeptide
  VL of XENP018628

SEQ ID NO: 7505 - protein, 5 aa, Artificial Sequence
  Description of Artificial Sequence: Synthetic peptide
  XENP018628 vhCDR1
NYWMN

SEQ ID NO: 7506 - protein, 19 aa, Artificial Sequence
  Description of Artificial Sequence: Synthetic peptide
  XENP018628 vhCDR2
EIRLKSNNYGTHYAEPVKG

SEQ ID NO: 7507 - protein, 11 aa, Artificial Sequence
  Description of Artificial Sequence: Synthetic peptide
  XENP018628 vhCDR3
YYGNYGGYFDV

SEQ ID NO: 7508 - protein, 11 aa, Artificial Sequence
  Description of Artificial Sequence: Synthetic peptide
  XENP018628 vlCDR1
RASQSVSNDVA

SEQ ID NO: 7509 - protein, 7 aa, Artificial Sequence
  Description of Artificial Sequence: Synthetic peptide
  XENP018628 vlCDR2
YASHRYT

SEQ ID NO: 7510 - protein, 9 aa, Artificial Sequence
  Description of Artificial Sequence: Synthetic peptide
  XENP018628 vlCDR3
QQDYSSPRT

SEQ ID NO: 7511 - protein, 249 aa, Artificial Sequence
  Description of Artificial Sequence: Synthetic polypeptide
  XENP018629 1G6_H1.129_L1_scFv(GKPGS)4
EVQLVESGGGLVKPGGSLRLSCAASGFTFSNYWMNWVRQAPGKGLEWVGEIRLKSNNYHTHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7512 - protein, 122 aa, Artificial Sequence
  Description of Artificial Sequence: Synthetic polypeptide
  VH of XENP018629
EVQLVESGGGLVKPGGSLRLSCAASGFTFSNYWMNWVRQAPGKGLEWVGEIRLKSNNYHTHYAEPVKGRFTISRDDSKSTVYLQMNSLKTEDTAVYYCTRYYGNYGGYFDVWGAGTLVTVSS

SEQ ID NO: 7513 - protein, 107 aa, Artificial Sequence; identical to SEQ ID NO: 6247
  Description of Artificial Sequence: Synthetic polypeptide
  VL of XENP018629

SEQ ID NO: 7514 - protein, 5 aa, Artificial Sequence
  Description of Artificial Sequence: Synthetic peptide
  XENP018629 vhCDR1
NYWMN

SEQ ID NO: 7515 - protein, 19 aa, Artificial Sequence
  Description of Artificial Sequence: Synthetic peptide
  XENP018629 vhCDR2
EIRLKSNNYHTHYAEPVKG

SEQ ID NO: 7516 - protein, 11 aa, Artificial Sequence
  Description of Artificial Sequence: Synthetic peptide
  XENP018629 vhCDR3
YYGNYGGYFDV

SEQ ID NO: 7517 - protein, 11 aa, Artificial Sequence
  Description of Artificial Sequence: Synthetic peptide
  XENP018629 vlCDR1
RASQSVSNDVA

SEQ ID NO: 7518 - protein, 7 aa, Artificial Sequence
  Description of Artificial Sequence: Synthetic peptide
  XENP018629 vlCDR2
YASHRYT

SEQ ID NO: 7519 - protein, 9 aa, Artificial Sequence
  Description of Artificial Sequence: Synthetic peptide
  XENP018629 vlCDR3
QQDYSSPRT

SEQ ID NO: 7520 - protein, 249 aa, Artificial Sequence
  Description of Artificial Sequence: Synthetic polypeptide
  XENP018630 1G6_H1.130_L1_scFv(GKPGS)4
EVQLVESGGGLVKPGGSLRLSCAASGFTFSNYWMNWVRQAPGKGLEWVGEIRLKSNNYQTHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7521 - protein, 122 aa, Artificial Sequence
  Description of Artificial Sequence: Synthetic polypeptide
  VH of XENP018630
EVQLVESGGGLVKPGGSLRLSCAASGFTFSNYWMNWVRQAPGKGLEWVGEIRLKSNNYQTHYAEPVKGRFTISRDDSKSTVYLQMNSLKTEDTAVYYCTRYYGNYGGYFDVWGAGTLVTVSS

SEQ ID NO: 7522 - protein, 107 aa, Artificial Sequence; identical to SEQ ID NO: 6247
  Description of Artificial Sequence: Synthetic polypeptide
  VL of XENP018630

SEQ ID NO: 7523 - protein, 5 aa, Artificial Sequence
  Description of Artificial Sequence: Synthetic peptide
  XENP018630 vhCDR1
NYWMN

SEQ ID NO: 7524 - protein, 19 aa, Artificial Sequence
  Description of Artificial Sequence: Synthetic peptide
  XENP018630 vhCDR2
EIRLKSNNYQTHYAEPVKG

SEQ ID NO: 7525 - protein, 11 aa, Artificial Sequence
  Description of Artificial Sequence: Synthetic peptide
  XENP018630 vhCDR3
YYGNYGGYFDV

SEQ ID NO: 7526 - protein, 11 aa, Artificial Sequence
  Description of Artificial Sequence: Synthetic peptide
  XENP018630 vlCDR1
RASQSVSNDVA

SEQ ID NO: 7527 - protein, 7 aa, Artificial Sequence
  Description of Artificial Sequence: Synthetic peptide
  XENP018630 vlCDR2
YASHRYT

SEQ ID NO: 7528 - protein, 9 aa, Artificial Sequence
  Description of Artificial Sequence: Synthetic peptide
  XENP018630 vlCDR3
QQDYSSPRT

SEQ ID NO: 7529 - protein, 249 aa, Artificial Sequence
  Description of Artificial Sequence: Synthetic polypeptide
  XENP018631 1G6_H1.131_L1_scFv(GKPGS)4
EVQLVESGGGLVKPGGSLRLSCAASGFTFSNYWMNWVRQAPGKGLEWVGEIRLKSNNYDTHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7530 - protein, 122 aa, Artificial Sequence
  Description of Artificial Sequence: Synthetic polypeptide
  VH of XENP018631
EVQLVESGGGLVKPGGSLRLSCAASGFTFSNYWMNWVRQAPGKGLEWVGEIRLKSNNYDTHYAEPVKGRFTISRDDSKSTVYLQMNSLKTEDTAVYYCTRYYGNYGGYFDVWGAGTLVTVSS

SEQ ID NO: 7531 - protein, 107 aa, Artificial Sequence; identical to SEQ ID NO: 6247
  Description of Artificial Sequence: Synthetic polypeptide
  VL of XENP018631

SEQ ID NO: 7532 - protein, 5 aa, Artificial Sequence
  Description of Artificial Sequence: Synthetic peptide
  XENP018631 vhCDR1
NYWMN

SEQ ID NO: 7533 - protein, 19 aa, Artificial Sequence
  Description of Artificial Sequence: Synthetic peptide
  XENP018631 vhCDR2
EIRLKSNNYDTHYAEPVKG

SEQ ID NO: 7534 - protein, 11 aa, Artificial Sequence
  Description of Artificial Sequence: Synthetic peptide
  XENP018631 vhCDR3
YYGNYGGYFDV

SEQ ID NO: 7535 - protein, 11 aa, Artificial Sequence
  Description of Artificial Sequence: Synthetic peptide
  XENP018631 vlCDR1
RASQSVSNDVA

SEQ ID NO: 7536 - protein, 7 aa, Artificial Sequence
  Description of Artificial Sequence: Synthetic peptide
  XENP018631 vlCDR2
YASHRYT

SEQ ID NO: 7537 - protein, 9 aa, Artificial Sequence
  Description of Artificial Sequence: Synthetic peptide
  XENP018631 vlCDR3
QQDYSSPRT

SEQ ID NO: 7538 - protein, 249 aa, Artificial Sequence
  Description of Artificial Sequence: Synthetic polypeptide
  XENP018632 1G6_H1.132_L1_scFv(GKPGS)4
EVQLVESGGGLVKPGGSLRLSCAASGFTFSNYWMNWVRQAPGKGLEWVGEIRLKSNNYLTHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7539 - protein, 122 aa, Artificial Sequence
  Description of Artificial Sequence: Synthetic polypeptide
  VH of XENP018632
EVQLVESGGGLVKPGGSLRLSCAASGFTFSNYWMNWVRQAPGKGLEWVGEIRLKSNNYLTHYAEPVKGRFTISRDDSKSTVYLQMNSLKTEDTAVYYCTRYYGNYGGYFDVWGAGTLVTVSS

SEQ ID NO: 7540 - protein, 107 aa, Artificial Sequence; identical to SEQ ID NO: 6247
  Description of Artificial Sequence: Synthetic polypeptide
  VL of XENP018632

SEQ ID NO: 7541 - protein, 5 aa, Artificial Sequence
  Description of Artificial Sequence: Synthetic peptide
  XENP018632 vhCDR1
NYWMN

SEQ ID NO: 7542 - protein, 19 aa, Artificial Sequence
  Description of Artificial Sequence: Synthetic peptide
  XENP018632 vhCDR2
EIRLKSNNYLTHYAEPVKG

SEQ ID NO: 7543 - protein, 11 aa, Artificial Sequence
  Description of Artificial Sequence: Synthetic peptide
  XENP018632 vhCDR3
YYGNYGGYFDV

SEQ ID NO: 7544 - protein, 11 aa, Artificial Sequence
  Description of Artificial Sequence: Synthetic peptide
  XENP018632 vlCDR1
RASQSVSNDVA

SEQ ID NO: 7545 - protein, 7 aa, Artificial Sequence
  Description of Artificial Sequence: Synthetic peptide
  XENP018632 vlCDR2
YASHRYT

SEQ ID NO: 7546 - protein, 9 aa, Artificial Sequence
  Description of Artificial Sequence: Synthetic peptide
  XENP018632 vlCDR3
QQDYSSPRT

SEQ ID NO: 7547 - protein, 249 aa, Artificial Sequence
  Description of Artificial Sequence: Synthetic polypeptide
  XENP018633 1G6_H1.133_L1_scFv(GKPGS)4
EVQLVESGGGLVKPGGSLRLSCAASGFTFSNYWMNWVRQAPGKGLEWVGEIRLKSNNYKTHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7548 - protein, 122 aa, Artificial Sequence
  Description of Artificial Sequence: Synthetic polypeptide
  VH of XENP018633
EVQLVESGGGLVKPGGSLRLSCAASGFTFSNYWMNWVRQAPGKGLEWVGEIRLKSNNYKTHYAEPVKGRFTISRDDSKSTVYLQMNSLKTEDTAVYYCTRYYGNYGGYFDVWGAGTLVTVSS

SEQ ID NO: 7549 - protein, 107 aa, Artificial Sequence; identical to SEQ ID NO: 6247
  Description of Artificial Sequence: Synthetic polypeptide
  VL of XENP018633

SEQ ID NO: 7550 - protein, 5 aa, Artificial Sequence
  Description of Artificial Sequence: Synthetic peptide
  XENP018633 vhCDR1
NYWMN

SEQ ID NO: 7551 - protein, 19 aa, Artificial Sequence
  Description of Artificial Sequence: Synthetic peptide
  XENP018633 vhCDR2
EIRLKSNNYKTHYAEPVKG

SEQ ID NO: 7552 - protein, 11 aa, Artificial Sequence
  Description of Artificial Sequence: Synthetic peptide
  XENP018633 vhCDR3
YYGNYGGYFDV

SEQ ID NO: 7553 - protein, 11 aa, Artificial Sequence
  Description of Artificial Sequence: Synthetic peptide
  XENP018633 vlCDR1
RASQSVSNDVA

SEQ ID NO: 7554 - protein, 7 aa, Artificial Sequence
  Description of Artificial Sequence: Synthetic peptide
  XENP018633 vlCDR2
YASHRYT

SEQ ID NO: 7555 - protein, 9 aa, Artificial Sequence
  Description of Artificial Sequence: Synthetic peptide
  XENP018633 vlCDR3
QQDYSSPRT

SEQ ID NO: 7556 - protein, 249 aa, Artificial Sequence
  Description of Artificial Sequence: Synthetic polypeptide
  XENP018634 1G6_H1.134_L1_scFv(GKPGS)4
EVQLVESGGGLVKPGGSLRLSCAASGFTFSNYWMNWVRQAPGKGLEWVGEIRLKSNNYYTHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7557 - protein, 122 aa, Artificial Sequence
  Description of Artificial Sequence: Synthetic polypeptide
  VH of XENP018634
EVQLVESGGGLVKPGGSLRLSCAASGFTFSNYWMNWVRQAPGKGLEWVGEIRLKSNNYYTHYAEPVKGRFTISRDDSKSTVYLQMNSLKTEDTAVYYCTRYYGNYGGYFDVWGAGTLVTVSS

SEQ ID NO: 7558 - protein, 107 aa, Artificial Sequence; identical to SEQ ID NO: 6247
  Description of Artificial Sequence: Synthetic polypeptide
  VL of XENP018634

SEQ ID NO: 7559 - protein, 5 aa, Artificial Sequence
  Description of Artificial Sequence: Synthetic peptide
  XENP018634 vhCDR1
NYWMN

SEQ ID NO: 7560 - protein, 19 aa, Artificial Sequence
  Description of Artificial Sequence: Synthetic peptide
  XENP018634 vhCDR2
EIRLKSNNYYTHYAEPVKG

SEQ ID NO: 7561 - protein, 11 aa, Artificial Sequence
  Description of Artificial Sequence: Synthetic peptide
  XENP018634 vhCDR3
YYGNYGGYFDV

SEQ ID NO: 7562 - protein, 11 aa, Artificial Sequence
  Description of Artificial Sequence: Synthetic peptide
  XENP018634 vlCDR1
RASQSVSNDVA

SEQ ID NO: 7563 - protein, 7 aa, Artificial Sequence
  Description of Artificial Sequence: Synthetic peptide
  XENP018634 vlCDR2
YASHRYT

SEQ ID NO: 7564 - protein, 9 aa, Artificial Sequence
  Description of Artificial Sequence: Synthetic peptide
  XENP018634 vlCDR3
QQDYSSPRT

SEQ ID NO: 7565 - protein, 249 aa, Artificial Sequence
  Description of Artificial Sequence: Synthetic polypeptide
  XENP018635 1G6_H1.135_L1_scFv(GKPGS)4
EVQLVESGGGLVKPGGSLRLSCAASGFTFSNYWMNWVRQAPGKGLEWVGEIRLKSNNYAKHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7566 - protein, 122 aa, Artificial Sequence
  Description of Artificial Sequence: Synthetic polypeptide
  VH of XENP018635
EVQLVESGGGLVKPGGSLRLSCAASGFTFSNYWMNWVRQAPGKGLEWVGEIRLKSNNYAKHYAEPVKGRFTISRDDSKSTVYLQMNSLKTEDTAVYYCTRYYGNYGGYFDVWGAGTLVTVSS

SEQ ID NO: 7567 - protein, 107 aa, Artificial Sequence; identical to SEQ ID NO: 6247
  Description of Artificial Sequence: Synthetic polypeptide
  VL of XENP018635

SEQ ID NO: 7568 - protein, 5 aa, Artificial Sequence
  Description of Artificial Sequence: Synthetic peptide
  XENP018635 vhCDR1
NYWMN

SEQ ID NO: 7569 - protein, 19 aa, Artificial Sequence
  Description of Artificial Sequence: Synthetic peptide
  XENP018635 vhCDR2
EIRLKSNNYAKHYAEPVKG

SEQ ID NO: 7570 - protein, 11 aa, Artificial Sequence
  Description of Artificial Sequence: Synthetic peptide
  XENP018635 vhCDR3
YYGNYGGYFDV

SEQ ID NO: 7571 - protein, 11 aa, Artificial Sequence
  Description of Artificial Sequence: Synthetic peptide
  XENP018635 vlCDR1
RASQSVSNDVA

SEQ ID NO: 7572 - protein, 7 aa, Artificial Sequence
  Description of Artificial Sequence: Synthetic peptide
  XENP018635 vlCDR2
YASHRYT

SEQ ID NO: 7573 - protein, 9 aa, Artificial Sequence
  Description of Artificial Sequence: Synthetic peptide
  XENP018635 vlCDR3
QQDYSSPRT

SEQ ID NO: 7574 - protein, 249 aa, Artificial Sequence
  Description of Artificial Sequence: Synthetic polypeptide
  XENP018636 1G6_H1.136_L1_scFv(GKPGS)4
EVQLVESGGGLVKPGGSLRLSCAASGFTFSNYWMNWVRQAPGKGLEWVGEIRLKSNNYAIHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7575 - protein, 122 aa, Artificial Sequence
  Description of Artificial Sequence: Synthetic polypeptide
  VH of XENP018636
EVQLVESGGGLVKPGGSLRLSCAASGFTFSNYWMNWVRQAPGKGLEWVGEIRLKSNNYAIHYAEPVKGRFTISRDDSKSTVYLQMNSLKTEDTAVYYCTRYYGNYGGYFDVWGAGTLVTVSS

SEQ ID NO: 7576 - protein, 107 aa, Artificial Sequence; identical to SEQ ID NO: 6247
  Description of Artificial Sequence: Synthetic polypeptide
  VL of XENP018636

SEQ ID NO: 7577 - protein, 5 aa, Artificial Sequence
  Description of Artificial Sequence: Synthetic peptide
  XENP018636 vhCDR1
NYWMN

SEQ ID NO: 7578 - protein, 19 aa, Artificial Sequence
  Description of Artificial Sequence: Synthetic peptide
  XENP018636 vhCDR2
EIRLKSNNYAIHYAEPVKG

SEQ ID NO: 7579 - protein, 11 aa, Artificial Sequence
  Description of Artificial Sequence: Synthetic peptide
  XENP018636 vhCDR3
YYGNYGGYFDV

SEQ ID NO: 7580 - protein, 11 aa, Artificial Sequence
  Description of Artificial Sequence: Synthetic peptide
  XENP018636 vlCDR1
RASQSVSNDVA

SEQ ID NO: 7581 - protein, 7 aa, Artificial Sequence
  Description of Artificial Sequence: Synthetic peptide
  XENP018636 vlCDR2
YASHRYT

SEQ ID NO: 7582 - protein, 9 aa, Artificial Sequence
  Description of Artificial Sequence: Synthetic peptide
  XENP018636 vlCDR3
QQDYSSPRT

SEQ ID NO: 7583 - protein, 249 aa, Artificial Sequence
  Description of Artificial Sequence: Synthetic polypeptide
  XENP018637 1G6_H1.137_L1_scFv(GKPGS)4
EVQLVESGGGLVKPGGSLRLSCAASGFTFSNYWMNWVRQAPGKGLEWVGEIRLKSNNYATYYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7584 - protein, 122 aa, Artificial Sequence
  Description of Artificial Sequence: Synthetic polypeptide
  VH of XENP018637
EVQLVESGGGLVKPGGSLRLSCAASGFTFSNYWMNWVRQAPGKGLEWVGEIRLKSNNYATYYAEPVKGRFTISRDDSKSTVYLQMNSLKTEDTAVYYCTRYYGNYGGYFDVWGAGTLVTVSS

SEQ ID NO: 7585 - protein, 107 aa, Artificial Sequence; identical to SEQ ID NO: 6247
  Description of Artificial Sequence: Synthetic polypeptide
  VL of XENP018637

SEQ ID NO: 7586 - protein, 5 aa, Artificial Sequence
  Description of Artificial Sequence: Synthetic peptide
  XENP018637 vhCDR1
NYWMN

SEQ ID NO: 7587 - protein, 19 aa, Artificial Sequence
  Description of Artificial Sequence: Synthetic peptide
  XENP018637 vhCDR2
EIRLKSNNYATYYAEPVKG

SEQ ID NO: 7588 - protein, 11 aa, Artificial Sequence
  Description of Artificial Sequence: Synthetic peptide
  XENP018637 vhCDR3
YYGNYGGYFDV

SEQ ID NO: 7589 - protein, 11 aa, Artificial Sequence
  Description of Artificial Sequence: Synthetic peptide
  XENP018637 vlCDR1
RASQSVSNDVA

SEQ ID NO: 7590 - protein, 7 aa, Artificial Sequence
  Description of Artificial Sequence: Synthetic peptide
  XENP018637 vlCDR2
YASHRYT

SEQ ID NO: 7591 - protein, 9 aa, Artificial Sequence
  Description of Artificial Sequence: Synthetic peptide
  XENP018637 vlCDR3
QQDYSSPRT

SEQ ID NO: 7592 - protein, 249 aa, Artificial Sequence
  Description of Artificial Sequence: Synthetic polypeptide
  XENP018638 1G6_H1.138_L1_scFv(GKPGS)4
EVQLVESGGGLVKPGGSLRLSCAASGFTFSNYWMNWVRQAPGKGLEWVGEIRLKSNNYATQYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7593 - protein, 122 aa, Artificial Sequence
  Description of Artificial Sequence: Synthetic polypeptide
  VH of XENP018638
EVQLVESGGGLVKPGGSLRLSCAASGFTFSNYWMNWVRQAPGKGLEWVGEIRLKSNNYATQYAEPVKGRFTISRDDSKSTVYLQMNSLKTEDTAVYYCTRYYGNYGGYFDVWGAGTLVTVSS

SEQ ID NO: 7594 - protein, 107 aa, Artificial Sequence; identical to SEQ ID NO: 6247
  Description of Artificial Sequence: Synthetic polypeptide
  VL of XENP018638

SEQ ID NO: 7595 - protein, 5 aa, Artificial Sequence
  Description of Artificial Sequence: Synthetic peptide
  XENP018638 vhCDR1
NYWMN

SEQ ID NO: 7596 - protein, 19 aa, Artificial Sequence
  Description of Artificial Sequence: Synthetic peptide
  XENP018638 vhCDR2
EIRLKSNNYATQYAEPVKG

SEQ ID NO: 7597 - protein, 11 aa, Artificial Sequence
  Description of Artificial Sequence: Synthetic peptide
  XENP018638 vhCDR3
YYGNYGGYFDV

SEQ ID NO: 7598 - protein, 11 aa, Artificial Sequence
  Description of Artificial Sequence: Synthetic peptide
  XENP018638 vlCDR1
RASQSVSNDVA

SEQ ID NO: 7599 - protein, 7 aa, Artificial Sequence
  Description of Artificial Sequence: Synthetic peptide
  XENP018638 vlCDR2
YASHRYT

SEQ ID NO: 7600 - protein, 9 aa, Artificial Sequence
  Description of Artificial Sequence: Synthetic peptide
  XENP018638 vlCDR3
QQDYSSPRT

SEQ ID NO: 7601 - protein, 249 aa, Artificial Sequence
  Description of Artificial Sequence: Synthetic polypeptide
  XENP018639 1G6_H1.139_L1_scFv(GKPGS)4
EVQLVESGGGLVKPGGSLRLSCAASGFTFSNYWMNWVRQAPGKGLEWVGEIRLKSNNYATDYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7602 - protein, 122 aa, Artificial Sequence
  Description of Artificial Sequence: Synthetic polypeptide
  VH of XENP018639
EVQLVESGGGLVKPGGSLRLSCAASGFTFSNYWMNWVRQAPGKGLEWVGEIRLKSNNYATDYAEPVKGRFTISRDDSKSTVYLQMNSLKTEDTAVYYCTRYYGNYGGYFDVWGAGTLVTVSS

SEQ ID NO: 7603 - protein, 107 aa, Artificial Sequence; identical to SEQ ID NO: 6247
  Description of Artificial Sequence: Synthetic polypeptide
  VL of XENP018639

SEQ ID NO: 7604 - protein, 5 aa, Artificial Sequence
  Description of Artificial Sequence: Synthetic peptide
  XENP018639 vhCDR1
NYWMN

SEQ ID NO: 7605 - protein, 19 aa, Artificial Sequence
  Description of Artificial Sequence: Synthetic peptide
  XENP018639 vhCDR2
EIRLKSNNYATDYAEPVKG

SEQ ID NO: 7606 - protein, 11 aa, Artificial Sequence
  Description of Artificial Sequence: Synthetic peptide
  XENP018639 vhCDR3
YYGNYGGYFDV

SEQ ID NO: 7607 - protein, 11 aa, Artificial Sequence
  Description of Artificial Sequence: Synthetic peptide
  XENP018639 vlCDR1
RASQSVSNDVA

SEQ ID NO: 7608 - protein, 7 aa, Artificial Sequence
  Description of Artificial Sequence: Synthetic peptide
  XENP018639 vlCDR2
YASHRYT

SEQ ID NO: 7609 - protein, 9 aa, Artificial Sequence
  Description of Artificial Sequence: Synthetic peptide
  XENP018639 vlCDR3
QQDYSSPRT

SEQ ID NO: 7610 - protein, 249 aa, Artificial Sequence
  Description of Artificial Sequence: Synthetic polypeptide
  XENP018640 1G6_H1.140_L1_scFv(GKPGS)4
EVQLVESGGGLVKPGGSLRLSCAASGFTFSNYWMNWVRQAPGKGLEWVGEIRLKSNNYATFYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7611 - protein, 122 aa, Artificial Sequence
  Description of Artificial Sequence: Synthetic polypeptide
  VH of XENP018640
EVQLVESGGGLVKPGGSLRLSCAASGFTFSNYWMNWVRQAPGKGLEWVGEIRLKSNNYATFYAEPVKGRFTISRDDSKSTVYLQMNSLKTEDTAVYYCTRYYGNYGGYFDVWGAGTLVTVSS

SEQ ID NO: 7612 - protein, 107 aa, Artificial Sequence; identical to SEQ ID NO: 6247
  Description of Artificial Sequence: Synthetic polypeptide
  VL of XENP018640

SEQ ID NO: 7613 - protein, 5 aa, Artificial Sequence
  Description of Artificial Sequence: Synthetic peptide
  XENP018640 vhCDR1
NYWMN

SEQ ID NO: 7614 - protein, 19 aa, Artificial Sequence
  Description of Artificial Sequence: Synthetic peptide
  XENP018640 vhCDR2
EIRLKSNNYATFYAEPVKG

SEQ ID NO: 7615 - protein, 11 aa, Artificial Sequence
  Description of Artificial Sequence: Synthetic peptide
  XENP018640 vhCDR3
YYGNYGGYFDV

SEQ ID NO: 7616 - protein, 11 aa, Artificial Sequence
  Description of Artificial Sequence: Synthetic peptide
  XENP018640 vlCDR1
RASQSVSNDVA

SEQ ID NO: 7617 - protein, 7 aa, Artificial Sequence
  Description of Artificial Sequence: Synthetic peptide
  XENP018640 vlCDR2
YASHRYT

SEQ ID NO: 7618 - protein, 9 aa, Artificial Sequence
  Description of Artificial Sequence: Synthetic peptide
  XENP018640 vlCDR3
QQDYSSPRT

SEQ ID NO: 7619 - protein, 249 aa, Artificial Sequence
  Description of Artificial Sequence: Synthetic polypeptide
  XENP018641 1G6_H1.141_L1_scFv(GKPGS)4
EVQLVESGGGLVKPGGSLRLSCAASGFTFSNYWMNWVRQAPGKGLEWVGEIRLKSNNYATAYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7620 - protein, 122 aa, Artificial Sequence
  Description of Artificial Sequence: Synthetic polypeptide
  VH of XENP018641
EVQLVESGGGLVKPGGSLRLSCAASGFTFSNYWMNWVRQAPGKGLEWVGEIRLKSNNYATAYAEPVKGRFTISRDDSKSTVYLQMNSLKTEDTAVYYCTRYYGNYGGYFDVWGAGTLVTVSS

SEQ ID NO: 7621 - protein, 107 aa, Artificial Sequence; identical to SEQ ID NO: 6247
  Description of Artificial Sequence: Synthetic polypeptide
  VL of XENP018641

SEQ ID NO: 7622 - protein, 5 aa, Artificial Sequence
  Description of Artificial Sequence: Synthetic peptide
  XENP018641 vhCDR1
NYWMN

SEQ ID NO: 7623 - protein, 19 aa, Artificial Sequence
  Description of Artificial Sequence: Synthetic peptide
  XENP018641 vhCDR2
EIRLKSNNYATAYAEPVKG

SEQ ID NO: 7624 - protein, 11 aa, Artificial Sequence
  Description of Artificial Sequence: Synthetic peptide
  XENP018641 vhCDR3
YYGNYGGYFDV

SEQ ID NO: 7625 - protein, 11 aa, Artificial Sequence
  Description of Artificial Sequence: Synthetic peptide
  XENP018641 vlCDR1
RASQSVSNDVA

SEQ ID NO: 7626 - protein, 7 aa, Artificial Sequence
  Description of Artificial Sequence: Synthetic peptide
  XENP018641 vlCDR2
YASHRYT

SEQ ID NO: 7627 - protein, 9 aa, Artificial Sequence
  Description of Artificial Sequence: Synthetic peptide
  XENP018641 vlCDR3
QQDYSSPRT

SEQ ID NO: 7628 - protein, 249 aa, Artificial Sequence
  Description of Artificial Sequence: Synthetic polypeptide
  XENP018642 1G6_H1.142_L1_scFv(GKPGS)4
EVQLVESGGGLVKPGGSLRLSCAASGFTFSNYWMNWVRQAPGKGLEWVGEIRLKSNNYATTYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7629 - protein, 122 aa, Artificial Sequence
  Description of Artificial Sequence: Synthetic polypeptide
  VH of XENP018642
EVQLVESGGGLVKPGGSLRLSCAASGFTFSNYWMNWVRQAPGKGLEWVGEIRLKSNNYATTYAEPVKGRFTISRDDSKSTVYLQMNSLKTEDTAVYYCTRYYGNYGGYFDVWGAGTLVTVSS

SEQ ID NO: 7630 - protein, 107 aa, Artificial Sequence; identical to SEQ ID NO: 6247
  Description of Artificial Sequence: Synthetic polypeptide
  VL of XENP018642

SEQ ID NO: 7631 - protein, 5 aa, Artificial Sequence
  Description of Artificial Sequence: Synthetic peptide
  XENP018642 vhCDR1
NYWMN

SEQ ID NO: 7632 - protein, 19 aa, Artificial Sequence
  Description of Artificial Sequence: Synthetic peptide
  XENP018642 vhCDR2
EIRLKSNNYATTYAEPVKG

SEQ ID NO: 7633 - protein, 11 aa, Artificial Sequence
  Description of Artificial Sequence: Synthetic peptide
  XENP018642 vhCDR3
YYGNYGGYFDV

SEQ ID NO: 7634 - protein, 11 aa, Artificial Sequence
  Description of Artificial Sequence: Synthetic peptide
  XENP018642 vlCDR1
RASQSVSNDVA

SEQ ID NO: 7635 - protein, 7 aa, Artificial Sequence
  Description of Artificial Sequence: Synthetic peptide
  XENP018642 vlCDR2
YASHRYT

SEQ ID NO: 7636 - protein, 9 aa, Artificial Sequence
  Description of Artificial Sequence: Synthetic peptide
  XENP018642 vlCDR3
QQDYSSPRT

SEQ ID NO: 7637 - protein, 249 aa, Artificial Sequence
  Description of Artificial Sequence: Synthetic polypeptide
  XENP018643 1G6_H1.143_L1_scFv(GKPGS)4
EVQLVESGGGLVKPGGSLRLSCAASGFTFSNYWMNWVRQAPGKGLEWVGEIRLKSNNYATKYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7638 - protein, 122 aa, Artificial Sequence
  Description of Artificial Sequence: Synthetic polypeptide
  VH of XENP018643
EVQLVESGGGLVKPGGSLRLSCAASGFTFSNYWMNWVRQAPGKGLEWVGEIRLKSNNYATKYAEPVKGRFTISRDDSKSTVYLQMNSLKTEDTAVYYCTRYYGNYGGYFDVWGAGTLVTVSS

SEQ ID NO: 7639 - protein, 107 aa, Artificial Sequence; identical to SEQ ID NO: 6247
  Description of Artificial Sequence: Synthetic polypeptide
  VL of XENP018643

SEQ ID NO: 7640 - protein, 5 aa, Artificial Sequence
  Description of Artificial Sequence: Synthetic peptide
  XENP018643 vhCDR1
NYWMN

SEQ ID NO: 7641 - protein, 19 aa, Artificial Sequence
  Description of Artificial Sequence: Synthetic peptide
  XENP018643 vhCDR2
EIRLKSNNYATKYAEPVKG

SEQ ID NO: 7642 - protein, 11 aa, Artificial Sequence
  Description of Artificial Sequence: Synthetic peptide
  XENP018643 vhCDR3
YYGNYGGYFDV

SEQ ID NO: 7643 - protein, 11 aa, Artificial Sequence
  Description of Artificial Sequence: Synthetic peptide
  XENP018643 vlCDR1
RASQSVSNDVA

SEQ ID NO: 7644 - protein, 7 aa, Artificial Sequence
  Description of Artificial Sequence: Synthetic peptide
  XENP018643 vlCDR2
YASHRYT

SEQ ID NO: 7645 - protein, 9 aa, Artificial Sequence
  Description of Artificial Sequence: Synthetic peptide
  XENP018643 vlCDR3
QQDYSSPRT

SEQ ID NO: 7646 - protein, 249 aa, Artificial Sequence
  Description of Artificial Sequence: Synthetic polypeptide
  XENP018644 1G6_H1.144_L1_scFv(GKPGS)4
EVQLVESGGGLVKPGGSLRLSCAASGFTFSNYWMNWVRQAPGKGLEWVGEIRLKSNNYATGYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7647 - protein, 122 aa, Artificial Sequence
  Description of Artificial Sequence: Synthetic polypeptide
  VH of XENP018644
EVQLVESGGGLVKPGGSLRLSCAASGFTFSNYWMNWVRQAPGKGLEWVGEIRLKSNNYATGYAEPVKGRFTISRDDSKSTVYLQMNSLKTEDTAVYYCTRYYGNYGGYFDVWGAGTLVTVSS

SEQ ID NO: 7648 - protein, 107 aa, Artificial Sequence; identical to SEQ ID NO: 6247
  Description of Artificial Sequence: Synthetic polypeptide
  VL of XENP018644

SEQ ID NO: 7649 - protein, 5 aa, Artificial Sequence
  Description of Artificial Sequence: Synthetic peptide
  XENP018644 vhCDR1
NYWMN

SEQ ID NO: 7650 - protein, 19 aa, Artificial Sequence
  Description of Artificial Sequence: Synthetic peptide
  XENP018644 vhCDR2
EIRLKSNNYATGYAEPVKG

SEQ ID NO: 7651 - protein, 11 aa, Artificial Sequence
  Description of Artificial Sequence: Synthetic peptide
  XENP018644 vhCDR3
YYGNYGGYFDV

SEQ ID NO: 7652 - protein, 11 aa, Artificial Sequence
  Description of Artificial Sequence: Synthetic peptide
  XENP018644 vlCDR1
RASQSVSNDVA

SEQ ID NO: 7653 - protein, 7 aa, Artificial Sequence
  Description of Artificial Sequence: Synthetic peptide
  XENP018644 vlCDR2
YASHRYT

SEQ ID NO: 7654 - protein, 9 aa, Artificial Sequence
  Description of Artificial Sequence: Synthetic peptide
  XENP018644 vlCDR3
QQDYSSPRT

SEQ ID NO: 7655 - protein, 249 aa, Artificial Sequence
  Description of Artificial Sequence: Synthetic polypeptide
  XENP018645 1G6_H1.145_L1_scFv(GKPGS)4
EVQLVESGGGLVKPGGSLRLSCAASGFTFSNYWMNWVRQAPGKGLEWVGEIRLKSNNYATLYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7656 - protein, 122 aa, Artificial Sequence
  Description of Artificial Sequence: Synthetic polypeptide
  VH of XENP018645
EVQLVESGGGLVKPGGSLRLSCAASGFTFSNYWMNWVRQAPGKGLEWVGEIRLKSNNYATLYAEPVKGRFTISRDDSKSTVYLQMNSLKTEDTAVYYCTRYYGNYGGYFDVWGAGTLVTVSS

SEQ ID NO: 7657 - protein, 107 aa, Artificial Sequence; identical to SEQ ID NO: 6247
  Description of Artificial Sequence: Synthetic polypeptide
  VL of XENP018645

SEQ ID NO: 7658 - protein, 5 aa, Artificial Sequence
  Description of Artificial Sequence: Synthetic peptide
  XENP018645 vhCDR1
NYWMN

SEQ ID NO: 7659 - protein, 19 aa, Artificial Sequence
  Description of Artificial Sequence: Synthetic peptide
  XENP018645 vhCDR2
EIRLKSNNYATLYAEPVKG

SEQ ID NO: 7660 - protein, 11 aa, Artificial Sequence
  Description of Artificial Sequence: Synthetic peptide
  XENP018645 vhCDR3
YYGNYGGYFDV

SEQ ID NO: 7661 - protein, 11 aa, Artificial Sequence
  Description of Artificial Sequence: Synthetic peptide
  XENP018645 vlCDR1
RASQSVSNDVA

SEQ ID NO: 7662 - protein, 7 aa, Artificial Sequence
  Description of Artificial Sequence: Synthetic peptide
  XENP018645 vlCDR2
YASHRYT

SEQ ID NO: 7663 - protein, 9 aa, Artificial Sequence
  Description of Artificial Sequence: Synthetic peptide
  XENP018645 vlCDR3
QQDYSSPRT

SEQ ID NO: 7664 - protein, 249 aa, Artificial Sequence
  Description of Artificial Sequence: Synthetic polypeptide
  XENP018646 1G6_H1.146_L1_scFv(GKPGS)4
EVQLVESGGGLVKPGGSLRLSCAASGFTFSNYWMNWVRQAPGKGLEWVGEIRLKSNNYATHYPEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7665 - protein, 122 aa, Artificial Sequence
  Description of Artificial Sequence: Synthetic polypeptide
  VH of XENP018646
EVQLVESGGGLVKPGGSLRLSCAASGFTFSNYWMNWVRQAPGKGLEWVGEIRLKSNNYATHYPEPVKGRFTISRDDSKSTVYLQMNSLKTEDTAVYYCTRYYGNYGGYFDVWGAGTLVTVSS

SEQ ID NO: 7666 - protein, 107 aa, Artificial Sequence; identical to SEQ ID NO: 6247
  Description of Artificial Sequence: Synthetic polypeptide
  VL of XENP018646

SEQ ID NO: 7667 - protein, 5 aa, Artificial Sequence
  Description of Artificial Sequence: Synthetic peptide
  XENP018646 vhCDR1
NYWMN

SEQ ID NO: 7668 - protein, 19 aa, Artificial Sequence
  Description of Artificial Sequence: Synthetic peptide
  XENP018646 vhCDR2
EIRLKSNNYATHYPEPVKG

SEQ ID NO: 7669 - protein, 11 aa, Artificial Sequence
  Description of Artificial Sequence: Synthetic peptide
  XENP018646 vhCDR3
YYGNYGGYFDV

SEQ ID NO: 7670 - protein, 11 aa, Artificial Sequence
  Description of Artificial Sequence: Synthetic peptide
  XENP018646 vlCDR1
RASQSVSNDVA

SEQ ID NO: 7671 - protein, 7 aa, Artificial Sequence
  Description of Artificial Sequence: Synthetic peptide
  XENP018646 vlCDR2
YASHRYT

SEQ ID NO: 7672 - protein, 9 aa, Artificial Sequence
  Description of Artificial Sequence: Synthetic peptide
  XENP018646 vlCDR3
QQDYSSPRT

SEQ ID NO: 7673 - protein, 249 aa, Artificial Sequence
  Description of Artificial Sequence: Synthetic polypeptide
  XENP018647 1G6_H1.147_L1_scFv(GKPGS)4
EVQLVESGGGLVKPGGSLRLSCAASGFTFSNYWMNWVRQAPGKGLEWVGEIRLKSNNYATHYVEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7674 - protein, 122 aa, Artificial Sequence
  Description of Artificial Sequence: Synthetic polypeptide
  VH of XENP018647
EVQLVESGGGLVKPGGSLRLSCAASGFTFSNYWMNWVRQAPGKGLEWVGEIRLKSNNYATHYVEPVKGRFTISRDDSKSTVYLQMNSLKTEDTAVYYCTRYYGNYGGYFDVWGAGTLVTVSS

SEQ ID NO: 7675 - protein, 107 aa, Artificial Sequence; identical to SEQ ID NO: 6247
  Description of Artificial Sequence: Synthetic polypeptide
  VL of XENP018647

SEQ ID NO: 7676 - protein, 5 aa, Artificial Sequence
  Description of Artificial Sequence: Synthetic peptide
  XENP018647 vhCDR1
NYWMN

SEQ ID NO: 7677 - protein, 19 aa, Artificial Sequence
  Description of Artificial Sequence: Synthetic peptide
  XENP018647 vhCDR2
EIRLKSNNYATHYVEPVKG

SEQ ID NO: 7678 - protein, 11 aa, Artificial Sequence
  Description of Artificial Sequence: Synthetic peptide
  XENP018647 vhCDR3
YYGNYGGYFDV

SEQ ID NO: 7679 - protein, 11 aa, Artificial Sequence
  Description of Artificial Sequence: Synthetic peptide
  XENP018647 vlCDR1
RASQSVSNDVA

SEQ ID NO: 7680 - protein, 7 aa, Artificial Sequence
  Description of Artificial Sequence: Synthetic peptide
  XENP018647 vlCDR2
YASHRYT

SEQ ID NO: 7681 - protein, 9 aa, Artificial Sequence
  Description of Artificial Sequence: Synthetic peptide
  XENP018647 vlCDR3
QQDYSSPRT

SEQ ID NO: 7682 - protein, 249 aa, Artificial Sequence
  Description of Artificial Sequence: Synthetic polypeptide
  XENP018648 1G6_H1.148_L1_scFv(GKPGS)4
EVQLVESGGGLVKPGGSLRLSCAASGFTFSNYWMNWVRQAPGKGLEWVGEIRLKSNNYATHYADPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7683 - protein, 122 aa, Artificial Sequence
  Description of Artificial Sequence: Synthetic polypeptide
  VH of XENP018648
EVQLVESGGGLVKPGGSLRLSCAASGFTFSNYWMNWVRQAPGKGLEWVGEIRLKSNNYATHYADPVKGRFTISRDDSKSTVYLQMNSLKTEDTAVYYCTRYYGNYGGYFDVWGAGTLVTVSS

SEQ ID NO: 7684 - protein, 107 aa, Artificial Sequence; identical to SEQ ID NO: 6247
  Description of Artificial Sequence: Synthetic polypeptide
  VL of XENP018648

SEQ ID NO: 7685 - protein, 5 aa, Artificial Sequence
  Description of Artificial Sequence: Synthetic peptide
  XENP018648 vhCDR1
NYWMN

SEQ ID NO: 7686 - protein, 19 aa, Artificial Sequence
  Description of Artificial Sequence: Synthetic peptide
  XENP018648 vhCDR2
EIRLKSNNYATHYADPVKG

SEQ ID NO: 7687 - protein, 11 aa, Artificial Sequence
  Description of Artificial Sequence: Synthetic peptide
  XENP018648 vhCDR3
YYGNYGGYFDV

SEQ ID NO: 7688 - protein, 11 aa, Artificial Sequence
  Description of Artificial Sequence: Synthetic peptide
  XENP018648 vlCDR1
RASQSVSNDVA

SEQ ID NO: 7689 - protein, 7 aa, Artificial Sequence
  Description of Artificial Sequence: Synthetic peptide
  XENP018648 vlCDR2
YASHRYT

SEQ ID NO: 7690 - protein, 9 aa, Artificial Sequence
  Description of Artificial Sequence: Synthetic peptide
  XENP018648 vlCDR3
QQDYSSPRT

SEQ ID NO: 7691 - protein, 249 aa, Artificial Sequence
  Description of Artificial Sequence: Synthetic polypeptide
  XENP018649 1G6_H1.149_L1_scFv(GKPGS)4
EVQLVESGGGLVKPGGSLRLSCAASGFTFSNYWMNWVRQAPGKGLEWVGEIRLKSNNYATHYAGPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7692 - protein, 122 aa, Artificial Sequence
  Description of Artificial Sequence: Synthetic polypeptide
  VH of XENP018649
EVQLVESGGGLVKPGGSLRLSCAASGFTFSNYWMNWVRQAPGKGLEWVGEIRLKSNNYATHYAGPVKGRFTISRDDSKSTVYLQMNSLKTEDTAVYYCTRYYGNYGGYFDVWGAGTLVTVSS

SEQ ID NO: 7693 - protein, 107 aa, Artificial Sequence; identical to SEQ ID NO: 6247
  Description of Artificial Sequence: Synthetic polypeptide
  VL of XENP018649

SEQ ID NO: 7694 - protein, 5 aa, Artificial Sequence
  Description of Artificial Sequence: Synthetic peptide
  XENP018649 vhCDR1
NYWMN

SEQ ID NO: 7695 - protein, 19 aa, Artificial Sequence
  Description of Artificial Sequence: Synthetic peptide
  XENP018649 vhCDR2
EIRLKSNNYATHYAGPVKG

SEQ ID NO: 7696 - protein, 11 aa, Artificial Sequence
  Description of Artificial Sequence: Synthetic peptide
  XENP018649 vhCDR3
YYGNYGGYFDV

SEQ ID NO: 7697 - protein, 11 aa, Artificial Sequence
  Description of Artificial Sequence: Synthetic peptide
  XENP018649 vlCDR1
RASQSVSNDVA

SEQ ID NO: 7698 - protein, 7 aa, Artificial Sequence
  Description of Artificial Sequence: Synthetic peptide
  XENP018649 vlCDR2
YASHRYT

SEQ ID NO: 7699 - protein, 9 aa, Artificial Sequence
  Description of Artificial Sequence: Synthetic peptide
  XENP018649 vlCDR3
QQDYSSPRT

SEQ ID NO: 7700 - protein, 249 aa, Artificial Sequence
  Description of Artificial Sequence: Synthetic polypeptide
  XENP018650 1G6_H1.150_L1_scFv(GKPGS)4
EVQLVESGGGLVKPGGSLRLSCAASGFTFSNYWMNWVRQAPGKGLEWVGEIRLKSNNYATHYAAPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7701 - protein, 122 aa, Artificial Sequence
  Description of Artificial Sequence: Synthetic polypeptide
  VH of XENP018650
EVQLVESGGGLVKPGGSLRLSCAASGFTFSNYWMNWVRQAPGKGLEWVGEIRLKSNNYATHYAAPVKGRFTISRDDSKSTVYLQMNSLKTEDTAVYYCTRYYGNYGGYFDVWGAGTLVTVSS

SEQ ID NO: 7702 - protein, 107 aa, Artificial Sequence; identical to SEQ ID NO: 6247
  Description of Artificial Sequence: Synthetic polypeptide
  VL of XENP018650

SEQ ID NO: 7703 - protein, 5 aa, Artificial Sequence
  Description of Artificial Sequence: Synthetic peptide
  XENP018650 vhCDR1
NYWMN

SEQ ID NO: 7704 - protein, 19 aa, Artificial Sequence
  Description of Artificial Sequence: Synthetic peptide
  XENP018650 vhCDR2
EIRLKSNNYATHYAAPVKG

SEQ ID NO: 7705 - protein, 11 aa, Artificial Sequence
  Description of Artificial Sequence: Synthetic peptide
  XENP018650 vhCDR3
YYGNYGGYFDV

SEQ ID NO: 7706 - protein, 11 aa, Artificial Sequence
  Description of Artificial Sequence: Synthetic peptide
  XENP018650 vlCDR1
RASQSVSNDVA

SEQ ID NO: 7707 - protein, 7 aa, Artificial Sequence
  Description of Artificial Sequence: Synthetic peptide
  XENP018650 vlCDR2
YASHRYT

SEQ ID NO: 7708 - protein, 9 aa, Artificial Sequence
  Description of Artificial Sequence: Synthetic peptide
  XENP018650 vlCDR3
QQDYSSPRT

SEQ ID NO: 7709 - protein, 249 aa, Artificial Sequence
  Description of Artificial Sequence: Synthetic polypeptide
  XENP018651 1G6_H1.151_L1_scFv(GKPGS)4
EVQLVESGGGLVKPGGSLRLSCAASGFTFSNYWMNWVRQAPGKGLEWVGEIRLKSNNYATHYAESVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7710 - protein, 122 aa, Artificial Sequence
  Description of Artificial Sequence: Synthetic polypeptide
  VH of XENP018651
EVQLVESGGGLVKPGGSLRLSCAASGFTFSNYWMNWVRQAPGKGLEWVGEIRLKSNNYATHYAESVKGRFTISRDDSKSTVYLQMNSLKTEDTAVYYCTRYYGNYGGYFDVWGAGTLVTVSS

SEQ ID NO: 7711 - protein, 107 aa, Artificial Sequence; identical to SEQ ID NO: 6247
  Description of Artificial Sequence: Synthetic polypeptide
  VL of XENP018651

SEQ ID NO: 7712 - protein, 5 aa, Artificial Sequence
  Description of Artificial Sequence: Synthetic peptide
  XENP018651 vhCDR1
NYWMN

SEQ ID NO: 7713 - protein, 19 aa, Artificial Sequence
  Description of Artificial Sequence: Synthetic peptide
  XENP018651 vhCDR2
EIRLKSNNYATHYAESVKG

SEQ ID NO: 7714 - protein, 11 aa, Artificial Sequence
  Description of Artificial Sequence: Synthetic peptide
  XENP018651 vhCDR3
YYGNYGGYFDV

SEQ ID NO: 7715 - protein, 11 aa, Artificial Sequence
  Description of Artificial Sequence: Synthetic peptide
  XENP018651 vlCDR1
RASQSVSNDVA

SEQ ID NO: 7716 - protein, 7 aa, Artificial Sequence
  Description of Artificial Sequence: Synthetic peptide
  XENP018651 vlCDR2
YASHRYT

SEQ ID NO: 7717 - protein, 9 aa, Artificial Sequence
  Description of Artificial Sequence: Synthetic peptide
  XENP018651 vlCDR3
QQDYSSPRT

SEQ ID NO: 7718 - protein, 249 aa, Artificial Sequence
  Description of Artificial Sequence: Synthetic polypeptide
  XENP018652 1G6_H1.152_L1_scFv(GKPGS)4
EVQLVESGGGLVKPGGSLRLSCAASGFTFSNYWMNWVRQAPGKGLEWVGEIRLKSNNYATHYAEPVKGRFTISRDNSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7719 - protein, 122 aa, Artificial Sequence
  Description of Artificial Sequence: Synthetic polypeptide
  VH of XENP018652
EVQLVESGGGLVKPGGSLRLSCAASGFTFSNYWMNWVRQAPGKGLEWVGEIRLKSNNYATHYAEPVKGRFTISRDNSKSTVYLQMNSLKTEDTAVYYCTRYYGNYGGYFDVWGAGTLVTVSS

SEQ ID NO: 7720 - protein, 107 aa, Artificial Sequence; identical to SEQ ID NO: 6247
  Description of Artificial Sequence: Synthetic polypeptide
  VL of XENP018652

SEQ ID NO: 7721 - protein, 5 aa, Artificial Sequence
  Description of Artificial Sequence: Synthetic peptide
  XENP018652 vhCDR1
NYWMN

SEQ ID NO: 7722 - protein, 19 aa, Artificial Sequence
  Description of Artificial Sequence: Synthetic peptide
  XENP018652 vhCDR2
EIRLKSNNYATHYAEPVKG

SEQ ID NO: 7723 - protein, 11 aa, Artificial Sequence
  Description of Artificial Sequence: Synthetic peptide
  XENP018652 vhCDR3
YYGNYGGYFDV

SEQ ID NO: 7724 - protein, 11 aa, Artificial Sequence
  Description of Artificial Sequence: Synthetic peptide
  XENP018652 vlCDR1
RASQSVSNDVA

SEQ ID NO: 7725 - protein, 7 aa, Artificial Sequence
  Description of Artificial Sequence: Synthetic peptide
  XENP018652 vlCDR2
YASHRYT

SEQ ID NO: 7726 - protein, 9 aa, Artificial Sequence
  Description of Artificial Sequence: Synthetic peptide
  XENP018652 vlCDR3
QQDYSSPRT

SEQ ID NO: 7727 - protein, 249 aa, Artificial Sequence
  Description of Artificial Sequence: Synthetic polypeptide
  XENP018653 1G6_H1.153_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKNTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7728 - protein, 122 aa, Artificial Sequence
  Description of Artificial Sequence: Synthetic polypeptide
  VH of XENP018653
EVQLVESGGGLVKPGGSLRLSCAASGFTFSNYWMNWVRQAPGKGLEWVGEIRLKSNNYATHYAEPVKGRFTISRDDSKNTVYLQMNSLKTEDTAVYYCTRYYGNYGGYFDVWGAGTLVTVSS

SEQ ID NO: 7729 - protein, 107 aa, Artificial Sequence; identical to SEQ ID NO: 6247
  Description of Artificial Sequence: Synthetic polypeptide
  VL of XENP018653

SEQ ID NO: 7730 - protein, 5 aa, Artificial Sequence
  Description of Artificial Sequence: Synthetic peptide
  XENP018653 vhCDR1
NYWMN

SEQ ID NO: 7731 - protein, 19 aa, Artificial Sequence
  Description of Artificial Sequence: Synthetic peptide
  XENP018653 vhCDR2
EIRLKSNNYATHYAEPVKG

SEQ ID NO: 7732 - protein, 11 aa, Artificial Sequence
  Description of Artificial Sequence: Synthetic peptide
  XENP018653 vhCDR3
YYGNYGGYFDV

SEQ ID NO: 7733 - protein, 11 aa, Artificial Sequence
  Description of Artificial Sequence: Synthetic peptide
  XENP018653 vlCDR1
RASQSVSNDVA

SEQ ID NO: 7734 - protein, 7 aa, Artificial Sequence
  Description of Artificial Sequence: Synthetic peptide
  XENP018653 vlCDR2
YASHRYT

SEQ ID NO: 7735 - protein, 9 aa, Artificial Sequence
  Description of Artificial Sequence: Synthetic peptide
  XENP018653 vlCDR3
QQDYSSPRT

SEQ ID NO: 7736 - protein, 249 aa, Artificial Sequence
  Description of Artificial Sequence: Synthetic polypeptide
  XENP018654 1G6_H1.154_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSSVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7737 - protein, 122 aa, Artificial Sequence
  Description of Artificial Sequence: Synthetic polypeptide
  VH of XENP018654
EVQLVESGGGLVKPGGSLRLSCAASGFTFSNYWMNWVRQAPGKGLEWVGEIRLKSNNYATHYAEPVKGRFTISRDDSKSSVYLQMNSLKTEDTAVYYCTRYYGNYGGYFDVWGAGTLVTVSS

SEQ ID NO: 7738 - protein, 107 aa, Artificial Sequence; identical to SEQ ID NO: 6247
  Description of Artificial Sequence: Synthetic polypeptide
  VL of XENP018654

SEQ ID NO: 7739 - protein, 5 aa, Artificial Sequence
  Description of Artificial Sequence: Synthetic peptide
  XENP018654 vhCDR1
NYWMN

SEQ ID NO: 7740 - protein, 19 aa, Artificial Sequence
  Description of Artificial Sequence: Synthetic peptide
  XENP018654 vhCDR2
EIRLKSNNYATHYAEPVKG

SEQ ID NO: 7741 - protein, 11 aa, Artificial Sequence
  Description of Artificial Sequence: Synthetic peptide
  XENP018654 vhCDR3
YYGNYGGYFDV

SEQ ID NO: 7742 - protein, 11 aa, Artificial Sequence
  Description of Artificial Sequence: Synthetic peptide
  XENP018654 vlCDR1
RASQSVSNDVA

SEQ ID NO: 7743 - protein, 7 aa, Artificial Sequence
  Description of Artificial Sequence: Synthetic peptide
  XENP018654 vlCDR2
YASHRYT

SEQ ID NO: 7744 - protein, 9 aa, Artificial Sequence
  Description of Artificial Sequence: Synthetic peptide
  XENP018654 vlCDR3
QQDYSSPRT

SEQ ID NO: 7745 - protein, 249 aa, Artificial Sequence
  Description of Artificial Sequence: Synthetic polypeptide
  XENP018655 1G6_H1.155_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTLYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7746 - protein, 122 aa, Artificial Sequence
  Description of Artificial Sequence: Synthetic polypeptide
  VH of XENP018655
EVQLVESGGGLVKPGGSLRLSCAASGFTFSNYWMNWVRQAPGKGLEWVGEIRLKSNNYATHYAEPVKGRFTISRDDSKSTLYLQMNSLKTEDTAVYYCTRYYGNYGGYFDVWGAGTLVTVSS

SEQ ID NO: 7747 - protein, 107 aa, Artificial Sequence; identical to SEQ ID NO: 6247
  Description of Artificial Sequence: Synthetic polypeptide
  VL of XENP018655

SEQ ID NO: 7748 - protein, 5 aa, Artificial Sequence
  Description of Artificial Sequence: Synthetic peptide
  XENP018655 vhCDR1
NYWMN

SEQ ID NO: 7749 - protein, 19 aa, Artificial Sequence
  Description of Artificial Sequence: Synthetic peptide
  XENP018655 vhCDR2
EIRLKSNNYATHYAEPVKG

SEQ ID NO: 7750 - protein, 11 aa, Artificial Sequence
  Description of Artificial Sequence: Synthetic peptide
  XENP018655 vhCDR3
YYGNYGGYFDV

SEQ ID NO: 7751 - protein, 11 aa, Artificial Sequence
  Description of Artificial Sequence: Synthetic peptide
  XENP018655 vlCDR1
RASQSVSNDVA

SEQ ID NO: 7752 - protein, 7 aa, Artificial Sequence
  Description of Artificial Sequence: Synthetic peptide
  XENP018655 vlCDR2
YASHRYT

SEQ ID NO: 7753 - protein, 9 aa, Artificial Sequence
  Description of Artificial Sequence: Synthetic peptide
  XENP018655 vlCDR3
QQDYSSPRT

SEQ ID NO: 7754 - protein, 249 aa, Artificial Sequence
  Description of Artificial Sequence: Synthetic polypeptide
  XENP018656 1G6_H1.156_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTAYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7755 - protein, 122 aa, Artificial Sequence
  Description of Artificial Sequence: Synthetic polypeptide
  VH of XENP018656
EVQLVESGGGLVKPGGSLRLSCAASGFTFSNYWMNWVRQAPGKGLEWVGEIRLKSNNYATHYAEPVKGRFTISRDDSKSTAYLQMNSLKTEDTAVYYCTRYYGNYGGYFDVWGAGTLVTVSS

SEQ ID NO: 7756 - protein, 107 aa, Artificial Sequence; identical to SEQ ID NO: 6247
  Description of Artificial Sequence: Synthetic polypeptide
  VL of XENP018656

SEQ ID NO: 7757 - protein, 5 aa, Artificial Sequence
  Description of Artificial Sequence: Synthetic peptide
  XENP018656 vhCDR1
NYWMN

SEQ ID NO: 7758 - protein, 19 aa, Artificial Sequence
  Description of Artificial Sequence: Synthetic peptide
  XENP018656 vhCDR2
EIRLKSNNYATHYAEPVKG

SEQ ID NO: 7759 - protein, 11 aa, Artificial Sequence
  Description of Artificial Sequence: Synthetic peptide
  XENP018656 vhCDR3
YYGNYGGYFDV

SEQ ID NO: 7760 - protein, 11 aa, Artificial Sequence
  Description of Artificial Sequence: Synthetic peptide
  XENP018656 vlCDR1
RASQSVSNDVA

SEQ ID NO: 7761 - protein, 7 aa, Artificial Sequence
  Description of Artificial Sequence: Synthetic peptide
  XENP018656 vlCDR2
YASHRYT

SEQ ID NO: 7762 - protein, 9 aa, Artificial Sequence
  Description of Artificial Sequence: Synthetic peptide
  XENP018656 vlCDR3
QQDYSSPRT

SEQ ID NO: 7763 - protein, 249 aa, Artificial Sequence
  Description of Artificial Sequence: Synthetic polypeptide
  XENP018657 1G6_H1.157_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNNLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7764 - protein, 122 aa, Artificial Sequence
  Description of Artificial Sequence: Synthetic polypeptide
  VH of XENP018657
EVQLVESGGGLVKPGGSLRLSCAASGFTFSNYWMNWVRQAPGKGLEWVGEIRLKSNNYATHYAEPVKGRFTISRDDSKSTVYLQMNNLKTEDTAVYYCTRYYGNYGGYFDVWGAGTLVTVSS

SEQ ID NO: 7765 - protein, 107 aa, Artificial Sequence; identical to SEQ ID NO: 6247
  Description of Artificial Sequence: Synthetic polypeptide
  VL of XENP018657

SEQ ID NO: 7766 - protein, 5 aa, Artificial Sequence
  Description of Artificial Sequence: Synthetic peptide
  XENP018657 vhCDR1
NYWMN

SEQ ID NO: 7767 - protein, 19 aa, Artificial Sequence
  Description of Artificial Sequence: Synthetic peptide
  XENP018657 vhCDR2
EIRLKSNNYATHYAEPVKG

SEQ ID NO: 7768 - protein, 11 aa, Artificial Sequence
  Description of Artificial Sequence: Synthetic peptide
  XENP018657 vhCDR3
YYGNYGGYFDV

SEQ ID NO: 7769 - protein, 11 aa, Artificial Sequence
  Description of Artificial Sequence: Synthetic peptide
  XENP018657 vlCDR1
RASQSVSNDVA

SEQ ID NO: 7770 - protein, 7 aa, Artificial Sequence
  Description of Artificial Sequence: Synthetic peptide
  XENP018657 vlCDR2
YASHRYT

SEQ ID NO: 7771 - protein, 9 aa, Artificial Sequence
  Description of Artificial Sequence: Synthetic peptide
  XENP018657 vlCDR3
QQDYSSPRT

SEQ ID NO: 7772 - protein, 249 aa, Artificial Sequence
  Description of Artificial Sequence: Synthetic polypeptide
  XENP018658 1G6_H1.158_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLRTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7773 - protein, 122 aa, Artificial Sequence
  Description of Artificial Sequence: Synthetic polypeptide
  VH of XENP018658
EVQLVESGGGLVKPGGSLRLSCAASGFTFSNYWMNWVRQAPGKGLEWVGEIRLKSNNYATHYAEPVKGRFTISRDDSKSTVYLQMNSLRTEDTAVYYCTRYYGNYGGYFDVWGAGTLVTVSS

SEQ ID NO: 7774 - protein, 107 aa, Artificial Sequence; identical to SEQ ID NO: 6247
  Description of Artificial Sequence: Synthetic polypeptide
  VL of XENP018658

SEQ ID NO: 7775 - protein, 5 aa, Artificial Sequence
  Description of Artificial Sequence: Synthetic peptide
  XENP018658 vhCDR1
NYWMN

SEQ ID NO: 7776 - protein, 19 aa, Artificial Sequence
  Description of Artificial Sequence: Synthetic peptide
  XENP018658 vhCDR2
EIRLKSNNYATHYAEPVKG

SEQ ID NO: 7777 - protein, 11 aa, Artificial Sequence
  Description of Artificial Sequence: Synthetic peptide
  XENP018658 vhCDR3
YYGNYGGYFDV

SEQ ID NO: 7778 - protein, 11 aa, Artificial Sequence
  Description of Artificial Sequence: Synthetic peptide
  XENP018658 vlCDR1
RASQSVSNDVA

SEQ ID NO: 7779 - protein, 7 aa, Artificial Sequence
  Description of Artificial Sequence: Synthetic peptide
  XENP018658 vlCDR2
YASHRYT

SEQ ID NO: 7780 - protein, 9 aa, Artificial Sequence
  Description of Artificial Sequence: Synthetic peptide
  XENP018658 vlCDR3
QQDYSSPRT

SEQ ID NO: 7781 - protein, 249 aa, Artificial Sequence
  Description of Artificial Sequence: Synthetic polypeptide
  XENP018659 1G6_H1.159_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKAEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7782 - protein, 122 aa, Artificial Sequence
  Description of Artificial Sequence: Synthetic polypeptide
  VH of XENP018659
EVQLVESGGGLVKPGGSLRLSCAASGFTFSNYWMNWVRQAPGKGLEWVGEIRLKSNNYATHYAEPVKGRFTISRDDSKSTVYLQMNSLKAEDTAVYYCTRYYGNYGGYFDVWGAGTLVTVSS

SEQ ID NO: 7783 - protein, 107 aa, Artificial Sequence; identical to SEQ ID NO: 6247
  Description of Artificial Sequence: Synthetic polypeptide
  VL of XENP018659

SEQ ID NO: 7784 - protein, 5 aa, Artificial Sequence
  Description of Artificial Sequence: Synthetic peptide
  XENP018659 vhCDR1
NYWMN

SEQ ID NO: 7785 - protein, 19 aa, Artificial Sequence
  Description of Artificial Sequence: Synthetic peptide
  XENP018659 vhCDR2
EIRLKSNNYATHYAEPVKG

SEQ ID NO: 7786 - protein, 11 aa, Artificial Sequence
  Description of Artificial Sequence: Synthetic peptide
  XENP018659 vhCDR3
YYGNYGGYFDV

SEQ ID NO: 7787 - protein, 11 aa, Artificial Sequence
  Description of Artificial Sequence: Synthetic peptide
  XENP018659 vlCDR1
RASQSVSNDVA

SEQ ID NO: 7788 - protein, 7 aa, Artificial Sequence
  Description of Artificial Sequence: Synthetic peptide
  XENP018659 vlCDR2
YASHRYT

SEQ ID NO: 7789 - protein, 9 aa, Artificial Sequence
  Description of Artificial Sequence: Synthetic peptide
  XENP018659 vlCDR3
QQDYSSPRT

SEQ ID NO: 7790 - protein, 249 aa, Artificial Sequence
  Description of Artificial Sequence: Synthetic polypeptide
  XENP018660 1G6_H1.160_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTGVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7791 - protein, 122 aa, Artificial Sequence
  Description of Artificial Sequence: Synthetic polypeptide
  VH of XENP018660
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTGVYYCTRYYGNYGGYFDVWGAGTLVTVSS

SEQ ID NO: 7792 - protein, 107 aa, Artificial Sequence; identical to SEQ ID NO: 6247
  Description of Artificial Sequence: Synthetic polypeptide
  VL of XENP018660

SEQ ID NO: 7793 - protein, 5 aa, Artificial Sequence
  Description of Artificial Sequence: Synthetic peptide
  XENP018660 vhCDR1
NYWMN

SEQ ID NO: 7794 - protein, 19 aa, Artificial Sequence
  Description of Artificial Sequence: Synthetic peptide
  XENP018660 vhCDR2
EIRLKSNNYATHYAEPVKG

SEQ ID NO: 7795 - protein, 11 aa, Artificial Sequence
  Description of Artificial Sequence: Synthetic peptide
  XENP018660 vhCDR3
YYGNYGGYFDV

SEQ ID NO: 7796 - protein, 11 aa, Artificial Sequence
  Description of Artificial Sequence: Synthetic peptide
  XENP018660 vlCDR1
RASQSVSNDVA

SEQ ID NO: 7797 - protein, 7 aa, Artificial Sequence
  Description of Artificial Sequence: Synthetic peptide
  XENP018660 vlCDR2
YASHRYT

SEQ ID NO: 7798 - protein, 9 aa, Artificial Sequence
  Description of Artificial Sequence: Synthetic peptide
  XENP018660 vlCDR3
QQDYSSPRT

SEQ ID NO: 7799 - protein, 249 aa, Artificial Sequence
  Description of Artificial Sequence: Synthetic polypeptide
  XENP018661 1G6_H1.161_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAIYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7800 - protein, 122 aa, Artificial Sequence
  Description of Artificial Sequence: Synthetic polypeptide
  VH of XENP018661
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAIYYCTRYYGNYGGYFDVWGAGTLVTVSS

SEQ ID NO: 7801 - protein, 107 aa, Artificial Sequence; identical to SEQ ID NO: 6247
  Description of Artificial Sequence: Synthetic polypeptide
  VL of XENP018661

SEQ ID NO: 7802 - protein, 5 aa, Artificial Sequence
  Description of Artificial Sequence: Synthetic peptide
  XENP018661 vhCDR1
NYWMN

SEQ ID NO: 7803 - protein, 19 aa, Artificial Sequence
  Description of Artificial Sequence: Synthetic peptide
  XENP018661 vhCDR2
EIRLKSNNYATHYAEPVKG

SEQ ID NO: 7804 - protein, 11 aa, Artificial Sequence
  Description of Artificial Sequence: Synthetic peptide
  XENP018661 vhCDR3
YYGNYGGYFDV

SEQ ID NO: 7805 - protein, 11 aa, Artificial Sequence
  Description of Artificial Sequence: Synthetic peptide
  XENP018661 vlCDR1
RASQSVSNDVA

SEQ ID NO: 7806 - protein, 7 aa, Artificial Sequence
  Description of Artificial Sequence: Synthetic peptide
  XENP018661 vlCDR2
YASHRYT

SEQ ID NO: 7807 - protein, 9 aa, Artificial Sequence
  Description of Artificial Sequence: Synthetic peptide
  XENP018661 vlCDR3
QQDYSSPRT

SEQ ID NO: 7808 - protein, 249 aa, Artificial Sequence
  Description of Artificial Sequence: Synthetic polypeptide
  XENP018662 1G6_H1.162_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYHCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7809 - protein, 122 aa, Artificial Sequence
  Description of Artificial Sequence: Synthetic polypeptide
  VH of XENP018662
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYHCTRYYGNYGGYFDVWGAGTLVTVSS

SEQ ID NO: 7810 - protein, 107 aa, Artificial Sequence; identical to SEQ ID NO: 6247
  Description of Artificial Sequence: Synthetic polypeptide
  VL of XENP018662

SEQ ID NO: 7811 - protein, 5 aa, Artificial Sequence
  Description of Artificial Sequence: Synthetic peptide
  XENP018662 vhCDR1
NYWMN

SEQ ID NO: 7812 - protein, 19 aa, Artificial Sequence
  Description of Artificial Sequence: Synthetic peptide
  XENP018662 vhCDR2
EIRLKSNNYATHYAEPVKG

SEQ ID NO: 7813 - protein, 11 aa, Artificial Sequence
  Description of Artificial Sequence: Synthetic peptide
  XENP018662 vhCDR3
YYGNYGGYFDV

SEQ ID NO: 7814 - protein, 11 aa, Artificial Sequence
  Description of Artificial Sequence: Synthetic peptide
  XENP018662 vlCDR1
RASQSVSNDVA

SEQ ID NO: 7815 - protein, 7 aa, Artificial Sequence
  Description of Artificial Sequence: Synthetic peptide
  XENP018662 vlCDR2
YASHRYT

SEQ ID NO: 7816 - protein, 9 aa, Artificial Sequence
  Description of Artificial Sequence: Synthetic peptide
  XENP018662 vlCDR3
QQDYSSPRT

SEQ ID NO: 7817 - protein, 249 aa, Artificial Sequence
  Description of Artificial Sequence: Synthetic polypeptide
  XENP018663 1G6_H1.163_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCARYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7818 - protein, 122 aa, Artificial Sequence
  Description of Artificial Sequence: Synthetic polypeptide
  VH of XENP018663
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCARYYGNYGGYFDVWGAGTLVTVSS

SEQ ID NO: 7819 - protein, 107 aa, Artificial Sequence; identical to SEQ ID NO: 6247
  Description of Artificial Sequence: Synthetic polypeptide
  VL of XENP018663

SEQ ID NO: 7820 - protein, 5 aa, Artificial Sequence
  Description of Artificial Sequence: Synthetic peptide
  XENP018663 vhCDR1
NYWMN

SEQ ID NO: 7821 - protein, 19 aa, Artificial Sequence
  Description of Artificial Sequence: Synthetic peptide
  XENP018663 vhCDR2
EIRLKSNNYATHYAEPVKG

SEQ ID NO: 7822 - protein, 11 aa, Artificial Sequence
  Description of Artificial Sequence: Synthetic peptide
  XENP018663 vhCDR3
YYGNYGGYFDV

SEQ ID NO: 7823 - protein, 11 aa, Artificial Sequence
  Description of Artificial Sequence: Synthetic peptide
  XENP018663 vlCDR1
RASQSVSNDVA

SEQ ID NO: 7824 - protein, 7 aa, Artificial Sequence
  Description of Artificial Sequence: Synthetic peptide
  XENP018663 vlCDR2
YASHRYT

SEQ ID NO: 7825 - protein, 9 aa, Artificial Sequence
  Description of Artificial Sequence: Synthetic peptide
  XENP018663 vlCDR3
QQDYSSPRT

SEQ ID NO: 7826 - protein, 249 aa, Artificial Sequence
  Description of Artificial Sequence: Synthetic polypeptide
  XENP018664 1G6_H1.164_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCVRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7827 - protein, 122 aa, Artificial Sequence
  Description of Artificial Sequence: Synthetic polypeptide
  VH of XENP018664
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCVRYYGNYGGYFDVWGAGTLVTVSS

SEQ ID NO: 7828 - protein, 107 aa, Artificial Sequence; identical to SEQ ID NO: 6247
  Description of Artificial Sequence: Synthetic polypeptide
  VL of XENP018664

SEQ ID NO: 7829 - protein, 5 aa, Artificial Sequence
  Description of Artificial Sequence: Synthetic peptide
  XENP018664 vhCDR1
NYWMN

SEQ ID NO: 7830 - protein, 19 aa, Artificial Sequence
  Description of Artificial Sequence: Synthetic peptide
  XENP018664 vhCDR2
EIRLKSNNYATHYAEPVKG

SEQ ID NO: 7831 - protein, 11 aa, Artificial Sequence
  Description of Artificial Sequence: Synthetic peptide
  XENP018664 vhCDR3
YYGNYGGYFDV

SEQ ID NO: 7832 - protein, 11 aa, Artificial Sequence
  Description of Artificial Sequence: Synthetic peptide
  XENP018664 vlCDR1
RASQSVSNDVA

SEQ ID NO: 7833 - protein, 7 aa, Artificial Sequence
  Description of Artificial Sequence: Synthetic peptide
  XENP018664 vlCDR2
YASHRYT

SEQ ID NO: 7834 - protein, 9 aa, Artificial Sequence
  Description of Artificial Sequence: Synthetic peptide
  XENP018664 vlCDR3
QQDYSSPRT

SEQ ID NO: 7835 - protein, 249 aa, Artificial Sequence
  Description of Artificial Sequence: Synthetic polypeptide
  XENP018665 1G6_H1.165_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTTYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7836 - protein, 122 aa, Artificial Sequence
  Description of Artificial Sequence: Synthetic polypeptide
  VH of XENP018665
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTTYYGNYGGYFDVWGAGTLVTVSS

SEQ ID NO: 7837 - protein, 107 aa, Artificial Sequence; identical to SEQ ID NO: 6247
  Description of Artificial Sequence: Synthetic polypeptide
  VL of XENP018665

SEQ ID NO: 7838 - protein, 5 aa, Artificial Sequence
  Description of Artificial Sequence: Synthetic peptide
  XENP018665 vhCDR1
NYWMN

SEQ ID NO: 7839 - protein, 19 aa, Artificial Sequence
  Description of Artificial Sequence: Synthetic peptide
  XENP018665 vhCDR2
EIRLKSNNYATHYAEPVKG

SEQ ID NO: 7840 - protein, 11 aa, Artificial Sequence
  Description of Artificial Sequence: Synthetic peptide
  XENP018665 vhCDR3
YYGNYGGYFDV

SEQ ID NO: 7841 - protein, 11 aa, Artificial Sequence
  Description of Artificial Sequence: Synthetic peptide
  XENP018665 vlCDR1
RASQSVSNDVA

SEQ ID NO: 7842 - protein, 7 aa, Artificial Sequence
  Description of Artificial Sequence: Synthetic peptide
  XENP018665 vlCDR2
YASHRYT

SEQ ID NO: 7843 - protein, 9 aa, Artificial Sequence
  Description of Artificial Sequence: Synthetic peptide
  XENP018665 vlCDR3
QQDYSSPRT

SEQ ID NO: 7844 - protein, 249 aa, Artificial Sequence
  Description of Artificial Sequence: Synthetic polypeptide
  XENP018666 1G6_H1.166_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTKYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7845 - protein, 122 aa, Artificial Sequence
  Description of Artificial Sequence: Synthetic polypeptide
  VH of XENP018666
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTKYYGNYGGYFDVWGAGTLVTVSS

SEQ ID NO: 7846 - protein, 107 aa, Artificial Sequence; identical to SEQ ID NO: 6247
  Description of Artificial Sequence: Synthetic polypeptide
  VL of XENP018666

SEQ ID NO: 7847 - protein, 5 aa, Artificial Sequence
  Description of Artificial Sequence: Synthetic peptide
  XENP018666 vhCDR1
NYWMN

SEQ ID NO: 7848 - protein, 19 aa, Artificial Sequence
  Description of Artificial Sequence: Synthetic peptide
  XENP018666 vhCDR2
EIRLKSNNYATHYAEPVKG

SEQ ID NO: 7849 - protein, 11 aa, Artificial Sequence
  Description of Artificial Sequence: Synthetic peptide
  XENP018666 vhCDR3
YYGNYGGYFDV

SEQ ID NO: 7850 - protein, 11 aa, Artificial Sequence
  Description of Artificial Sequence: Synthetic peptide
  XENP018666 vlCDR1
RASQSVSNDVA

SEQ ID NO: 7851 - protein, 7 aa, Artificial Sequence
  Description of Artificial Sequence: Synthetic peptide
  XENP018666 vlCDR2
YASHRYT

SEQ ID NO: 7852 - protein, 9 aa, Artificial Sequence
  Description of Artificial Sequence: Synthetic peptide
  XENP018666 vlCDR3
QQDYSSPRT

SEQ ID NO: 7853 - protein, 249 aa, Artificial Sequence
  Description of Artificial Sequence: Synthetic polypeptide
  XENP018667 1G6_H1.167_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRFYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7854 - protein, 122 aa, Artificial Sequence
  Description of Artificial Sequence: Synthetic polypeptide
  VH of XENP018667
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRFYGNYGGYFDVWGAGTLVTVSS

SEQ ID NO: 7855 - protein, 107 aa, Artificial Sequence; identical to SEQ ID NO: 6247
  Description of Artificial Sequence: Synthetic polypeptide
  VL of XENP018667

SEQ ID NO: 7856 - protein, 5 aa, Artificial Sequence
  Description of Artificial Sequence: Synthetic peptide
  XENP018667 vhCDR1
NYWMN

SEQ ID NO: 7857 - protein, 19 aa, Artificial Sequence
  Description of Artificial Sequence: Synthetic peptide
  XENP018667 vhCDR2
EIRLKSNNYATHYAEPVKG

SEQ ID NO: 7858 - protein, 11 aa, Artificial Sequence
  Description of Artificial Sequence: Synthetic peptide
  XENP018667 vhCDR3
FYGNYGGYFDV

SEQ ID NO: 7859 - protein, 11 aa, Artificial Sequence
  Description of Artificial Sequence: Synthetic peptide
  XENP018667 vlCDR1
RASQSVSNDVA

SEQ ID NO: 7860 - protein, 7 aa, Artificial Sequence
  Description of Artificial Sequence: Synthetic peptide
  XENP018667 vlCDR2
YASHRYT

SEQ ID NO: 7861 - protein, 9 aa, Artificial Sequence
  Description of Artificial Sequence: Synthetic peptide
  XENP018667 vlCDR3
QQDYSSPRT

SEQ ID NO: 7862 - protein, 249 aa, Artificial Sequence
  Description of Artificial Sequence: Synthetic polypeptide
  XENP018668 1G6_H1.168_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRHYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7863 - protein, 122 aa, Artificial Sequence
  Description of Artificial Sequence: Synthetic polypeptide
  VH of XENP018668
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRHYGNYGGYFDVWGAGTLVTVSS

SEQ ID NO: 7864 - protein, 107 aa, Artificial Sequence; identical to SEQ ID NO: 6247
  Description of Artificial Sequence: Synthetic polypeptide
  VL of XENP018668

SEQ ID NO: 7865 - protein, 5 aa, Artificial Sequence
  Description of Artificial Sequence: Synthetic peptide
  XENP018668 vhCDR1
NYWMN

SEQ ID NO: 7866 - protein, 19 aa, Artificial Sequence
  Description of Artificial Sequence: Synthetic peptide
  XENP018668 vhCDR2
EIRLKSNNYATHYAEPVKG

SEQ ID NO: 7867 - protein, 11 aa, Artificial Sequence
  Description of Artificial Sequence: Synthetic peptide
  XENP018668 vhCDR3
HYGNYGGYFDV

SEQ ID NO: 7868 - protein, 11 aa, Artificial Sequence
  Description of Artificial Sequence: Synthetic peptide
  XENP018668 vlCDR1
RASQSVSNDVA

SEQ ID NO: 7869 - protein, 7 aa, Artificial Sequence
  Description of Artificial Sequence: Synthetic peptide
  XENP018668 vlCDR2
YASHRYT

SEQ ID NO: 7870 - protein, 9 aa, Artificial Sequence
  Description of Artificial Sequence: Synthetic peptide
  XENP018668 vlCDR3
QQDYSSPRT

SEQ ID NO: 7871 - protein, 249 aa, Artificial Sequence
  Description of Artificial Sequence: Synthetic polypeptide
  XENP018669 1G6_H1.169_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRLYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7872 - protein, 122 aa, Artificial Sequence
  Description of Artificial Sequence: Synthetic polypeptide
  VH of XENP018669
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRLYGNYGGYFDVWGAGTLVTVSS

SEQ ID NO: 7873 - protein, 107 aa, Artificial Sequence; identical to SEQ ID NO: 6247
  Description of Artificial Sequence: Synthetic polypeptide
  VL of XENP018669

SEQ ID NO: 7874 - protein, 5 aa, Artificial Sequence
  Description of Artificial Sequence: Synthetic peptide
  XENP018669 vhCDR1
NYWMN

SEQ ID NO: 7875 - protein, 19 aa, Artificial Sequence
  Description of Artificial Sequence: Synthetic peptide
  XENP018669 vhCDR2
EIRLKSNNYATHYAEPVKG

SEQ ID NO: 7876 - protein, 11 aa, Artificial Sequence
  Description of Artificial Sequence: Synthetic peptide
  XENP018669 vhCDR3
LYGNYGGYFDV

SEQ ID NO: 7877 - protein, 11 aa, Artificial Sequence
  Description of Artificial Sequence: Synthetic peptide
  XENP018669 vlCDR1
RASQSVSNDVA

SEQ ID NO: 7878 - protein, 7 aa, Artificial Sequence
  Description of Artificial Sequence: Synthetic peptide
  XENP018669 vlCDR2
YASHRYT

SEQ ID NO: 7879 - protein, 9 aa, Artificial Sequence
  Description of Artificial Sequence: Synthetic peptide
  XENP018669 vlCDR3
QQDYSSPRT

SEQ ID NO: 7880 - protein, 249 aa, Artificial Sequence
  Description of Artificial Sequence: Synthetic polypeptide
  XENP018670 1G6_H1.170_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRWYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7881 - protein, 122 aa, Artificial Sequence
  Description of Artificial Sequence: Synthetic polypeptide
  VH of XENP018670
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRWYGNYGGYFDVWGAGTLVTVSS

SEQ ID NO: 7882 - protein, 107 aa, Artificial Sequence; identical to SEQ ID NO: 6247
  Description of Artificial Sequence: Synthetic polypeptide
  VL of XENP018670

SEQ ID NO: 7883 - protein, 5 aa, Artificial Sequence
  Description of Artificial Sequence: Synthetic peptide
  XENP018670 vhCDR1
NYWMN

SEQ ID NO: 7884 - protein, 19 aa, Artificial Sequence
  Description of Artificial Sequence: Synthetic peptide
  XENP018670 vhCDR2
EIRLKSNNYATHYAEPVKG

SEQ ID NO: 7885 - protein, 11 aa, Artificial Sequence
  Description of Artificial Sequence: Synthetic peptide
  XENP018670 vhCDR3
WYGNYGGYFDV

SEQ ID NO: 7886 - protein, 11 aa, Artificial Sequence
  Description of Artificial Sequence: Synthetic peptide
  XENP018670 vlCDR1
RASQSVSNDVA

SEQ ID NO: 7887 - protein, 7 aa, Artificial Sequence
  Description of Artificial Sequence: Synthetic peptide
  XENP018670 vlCDR2
YASHRYT

SEQ ID NO: 7888 - protein, 9 aa, Artificial Sequence
  Description of Artificial Sequence: Synthetic peptide
  XENP018670 vlCDR3
QQDYSSPRT

SEQ ID NO: 7889 - protein, 249 aa, Artificial Sequence
  Description of Artificial Sequence: Synthetic polypeptide
  XENP018671 1G6_H1.171_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRVYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7890 - protein, 122 aa, Artificial Sequence
  Description of Artificial Sequence: Synthetic polypeptide
  VH of XENP018671
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRVYGNYGGYFDVWGAGTLVTVSS

SEQ ID NO: 7891 - protein, 107 aa, Artificial Sequence; identical to SEQ ID NO: 6247
  Description of Artificial Sequence: Synthetic polypeptide
  VL of XENP018671

SEQ ID NO: 7892 - protein, 5 aa, Artificial Sequence
  Description of Artificial Sequence: Synthetic peptide
  XENP018671 vhCDR1
NYWMN

SEQ ID NO: 7893 - protein, 19 aa, Artificial Sequence
  Description of Artificial Sequence: Synthetic peptide
  XENP018671 vhCDR2
EIRLKSNNYATHYAEPVKG

SEQ ID NO: 7894 - protein, 11 aa, Artificial Sequence
  Description of Artificial Sequence: Synthetic peptide
  XENP018671 vhCDR3
VYGNYGGYFDV

SEQ ID NO: 7895 - protein, 11 aa, Artificial Sequence
  Description of Artificial Sequence: Synthetic peptide
  XENP018671 vlCDR1
RASQSVSNDVA

SEQ ID NO: 7896 - protein, 7 aa, Artificial Sequence
  Description of Artificial Sequence: Synthetic peptide
  XENP018671 vlCDR2
YASHRYT

SEQ ID NO: 7897 - protein, 9 aa, Artificial Sequence
  Description of Artificial Sequence: Synthetic peptide
  XENP018671 vlCDR3
QQDYSSPRT

SEQ ID NO: 7898 - protein, 249 aa, Artificial Sequence
  Description of Artificial Sequence: Synthetic polypeptide
  XENP018672 1G6_H1.172_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRAYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7899 - protein, 122 aa, Artificial Sequence
  Description of Artificial Sequence: Synthetic polypeptide
  VH of XENP018672
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRAYGNYGGYFDVWGAGTLVTVSS

SEQ ID NO: 7900 - protein, 107 aa, Artificial Sequence; identical to SEQ ID NO: 6247
  Description of Artificial Sequence: Synthetic polypeptide
  VL of XENP018672

SEQ ID NO: 7901 - protein, 5 aa, Artificial Sequence
  Description of Artificial Sequence: Synthetic peptide
  XENP018672 vhCDR1
NYWMN

SEQ ID NO: 7902 - protein, 19 aa, Artificial Sequence
  Description of Artificial Sequence: Synthetic peptide
  XENP018672 vhCDR2
EIRLKSNNYATHYAEPVKG

SEQ ID NO: 7903 - protein, 11 aa, Artificial Sequence
  Description of Artificial Sequence: Synthetic peptide
  XENP018672 vhCDR3
AYGNYGGYFDV

SEQ ID NO: 7904 - protein, 11 aa, Artificial Sequence
  Description of Artificial Sequence: Synthetic peptide
  XENP018672 vlCDR1
RASQSVSNDVA

SEQ ID NO: 7905 - protein, 7 aa, Artificial Sequence
  Description of Artificial Sequence: Synthetic peptide
  XENP018672 vlCDR2
YASHRYT

SEQ ID NO: 7906 - protein, 9 aa, Artificial Sequence
  Description of Artificial Sequence: Synthetic peptide
  XENP018672 vlCDR3
QQDYSSPRT

SEQ ID NO: 7907 - protein, 249 aa, Artificial Sequence
  Description of Artificial Sequence: Synthetic polypeptide
  XENP018673 1G6_H1.173_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRQYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7908 - protein, 122 aa, Artificial Sequence
  Description of Artificial Sequence: Synthetic polypeptide
  VH of XENP018673
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRQYGNYGGYFDVWGAGTLVTVSS

SEQ ID NO: 7909 - protein, 107 aa, Artificial Sequence; identical to SEQ ID NO: 6247
  Description of Artificial Sequence: Synthetic polypeptide
  VL of XENP018673

SEQ ID NO: 7910 - protein, 5 aa, Artificial Sequence
  Description of Artificial Sequence: Synthetic peptide
  XENP018673 vhCDR1
NYWMN

SEQ ID NO: 7911 - protein, 19 aa, Artificial Sequence
  Description of Artificial Sequence: Synthetic peptide
  XENP018673 vhCDR2
EIRLKSNNYATHYAEPVKG

SEQ ID NO: 7912 - protein, 11 aa, Artificial Sequence
  Description of Artificial Sequence: Synthetic peptide
  XENP018673 vhCDR3
QYGNYGGYFDV

SEQ ID NO: 7913 - protein, 11 aa, Artificial Sequence
  Description of Artificial Sequence: Synthetic peptide
  XENP018673 vlCDR1
RASQSVSNDVA

SEQ ID NO: 7914 - protein, 7 aa, Artificial Sequence
  Description of Artificial Sequence: Synthetic peptide
  XENP018673 vlCDR2
YASHRYT

SEQ ID NO: 7915 - protein, 9 aa, Artificial Sequence
  Description of Artificial Sequence: Synthetic peptide
  XENP018673 vlCDR3
QQDYSSPRT

SEQ ID NO: 7916 - protein, 249 aa, Artificial Sequence
  Description of Artificial Sequence: Synthetic polypeptide
  XENP018674 1G6_H1.174_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRDYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7917 - protein, 122 aa, Artificial Sequence
  Description of Artificial Sequence: Synthetic polypeptide
  VH of XENP018674
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRDYGNYGGYFDVWGAGTLVTVSS

SEQ ID NO: 7918 - protein, 107 aa, Artificial Sequence; identical to SEQ ID NO: 6247
  Description of Artificial Sequence: Synthetic polypeptide
  VL of XENP018674

SEQ ID NO: 7919 - protein, 5 aa, Artificial Sequence
  Description of Artificial Sequence: Synthetic peptide
  XENP018674 vhCDR1
NYWMN

SEQ ID NO: 7920 - protein, 19 aa, Artificial Sequence
  Description of Artificial Sequence: Synthetic peptide
  XENP018674 vhCDR2
EIRLKSNNYATHYAEPVKG

SEQ ID NO: 7921 - protein, 11 aa, Artificial Sequence
  Description of Artificial Sequence: Synthetic peptide
  XENP018674 vhCDR3
DYGNYGGYFDV

SEQ ID NO: 7922 - protein, 11 aa, Artificial Sequence
  Description of Artificial Sequence: Synthetic peptide
  XENP018674 vlCDR1
RASQSVSNDVA

SEQ ID NO: 7923 - protein, 7 aa, Artificial Sequence
  Description of Artificial Sequence: Synthetic peptide
  XENP018674 vlCDR2
YASHRYT

SEQ ID NO: 7924 - protein, 9 aa, Artificial Sequence
  Description of Artificial Sequence: Synthetic peptide
  XENP018674 vlCDR3
QQDYSSPRT

SEQ ID NO: 7925 - protein, 249 aa, Artificial Sequence
  Description of Artificial Sequence: Synthetic polypeptide
  XENP018675 1G6_H1.175_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRKYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7926 - protein, 122 aa, Artificial Sequence
  Description of Artificial Sequence: Synthetic polypeptide
  VH of XENP018675
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRKYGNYGGYFDVWGAGTLVTVSS

SEQ ID NO: 7927 - protein, 107 aa, Artificial Sequence; identical to SEQ ID NO: 6247
  Description of Artificial Sequence: Synthetic polypeptide
  VL of XENP018675

SEQ ID NO: 7928 - protein, 5 aa, Artificial Sequence
  Description of Artificial Sequence: Synthetic peptide
  XENP018675 vhCDR1
NYWMN

SEQ ID NO: 7929 - protein, 19 aa, Artificial Sequence
  Description of Artificial Sequence: Synthetic peptide
  XENP018675 vhCDR2
EIRLKSNNYATHYAEPVKG

SEQ ID NO: 7930 - protein, 11 aa, Artificial Sequence
  Description of Artificial Sequence: Synthetic peptide
  XENP018675 vhCDR3
KYGNYGGYFDV

SEQ ID NO: 7931 - protein, 11 aa, Artificial Sequence
  Description of Artificial Sequence: Synthetic peptide
  XENP018675 vlCDR1
RASQSVSNDVA

SEQ ID NO: 7932 - protein, 7 aa, Artificial Sequence
  Description of Artificial Sequence: Synthetic peptide
  XENP018675 vlCDR2
YASHRYT

SEQ ID NO: 7933 - protein, 9 aa, Artificial Sequence
  Description of Artificial Sequence: Synthetic peptide
  XENP018675 vlCDR3
QQDYSSPRT

SEQ ID NO: 7934 - protein, 249 aa, Artificial Sequence
  Description of Artificial Sequence: Synthetic polypeptide
  XENP018676 1G6_H1.176_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYFGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7935 - protein, 122 aa, Artificial Sequence
  Description of Artificial Sequence: Synthetic polypeptide
  VH of XENP018676
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYFGNYGGYFDVWGAGTLVTVSS

SEQ ID NO: 7936 - protein, 107 aa, Artificial Sequence; identical to SEQ ID NO: 6247
  Description of Artificial Sequence: Synthetic polypeptide
  VL of XENP018676

SEQ ID NO: 7937 - protein, 5 aa, Artificial Sequence
  Description of Artificial Sequence: Synthetic peptide
  XENP018676 vhCDR1
NYWMN

SEQ ID NO: 7938 - protein, 19 aa, Artificial Sequence
  Description of Artificial Sequence: Synthetic peptide
  XENP018676 vhCDR2
EIRLKSNNYATHYAEPVKG

SEQ ID NO: 7939 - protein, 11 aa, Artificial Sequence
  Description of Artificial Sequence: Synthetic peptide
  XENP018676 vhCDR3
YFGNYGGYFDV

SEQ ID NO: 7940 - protein, 11 aa, Artificial Sequence
  Description of Artificial Sequence: Synthetic peptide
  XENP018676 vlCDR1
RASQSVSNDVA

SEQ ID NO: 7941 - protein, 7 aa, Artificial Sequence
  Description of Artificial Sequence: Synthetic peptide
  XENP018676 vlCDR2
YASHRYT

SEQ ID NO: 7942 - protein, 9 aa, Artificial Sequence
  Description of Artificial Sequence: Synthetic peptide
  XENP018676 vlCDR3
QQDYSSPRT

SEQ ID NO: 7943 - protein, 249 aa, Artificial Sequence
  Description of Artificial Sequence: Synthetic polypeptide
  XENP018677 1G6_H1.177_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYHGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7944 - protein, 122 aa, Artificial Sequence
  Description of Artificial Sequence: Synthetic polypeptide
  VH of XENP018677
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYHGNYGGYFDVWGAGTLVTVSS

SEQ ID NO: 7945 - protein, 107 aa, Artificial Sequence; identical to SEQ ID NO: 6247
  Description of Artificial Sequence: Synthetic polypeptide
  VL of XENP018677

SEQ ID NO: 7946 - protein, 5 aa, Artificial Sequence
  Description of Artificial Sequence: Synthetic peptide
  XENP018677 vhCDR1
NYWMN

SEQ ID NO: 7947 - protein, 19 aa, Artificial Sequence
  Description of Artificial Sequence: Synthetic peptide
  XENP018677 vhCDR2
EIRLKSNNYATHYAEPVKG

SEQ ID NO: 7948 - protein, 11 aa, Artificial Sequence
  Description of Artificial Sequence: Synthetic peptide
  XENP018677 vhCDR3
YHGNYGGYFDV

SEQ ID NO: 7949 - protein, 11 aa, Artificial Sequence
  Description of Artificial Sequence: Synthetic peptide
  XENP018677 vlCDR1
RASQSVSNDVA

SEQ ID NO: 7950 - protein, 7 aa, Artificial Sequence
  Description of Artificial Sequence: Synthetic peptide
  XENP018677 vlCDR2
YASHRYT

SEQ ID NO: 7951 - protein, 9 aa, Artificial Sequence
  Description of Artificial Sequence: Synthetic peptide
  XENP018677 vlCDR3
QQDYSSPRT

SEQ ID NO: 7952 - protein, 249 aa, Artificial Sequence
  Description of Artificial Sequence: Synthetic polypeptide
  XENP018678 1G6_H1.178_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYLGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7953 - protein, 122 aa, Artificial Sequence
  Description of Artificial Sequence: Synthetic polypeptide
  VH of XENP018678
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYLGNYGGYFDVWGAGTLVTVSS

SEQ ID NO: 7954 - protein, 107 aa, Artificial Sequence; identical to SEQ ID NO: 6247
  Description of Artificial Sequence: Synthetic polypeptide
  VL of XENP018678

SEQ ID NO: 7955 - protein, 5 aa, Artificial Sequence
  Description of Artificial Sequence: Synthetic peptide
  XENP018678 vhCDR1
NYWMN

SEQ ID NO: 7956 - protein, 19 aa, Artificial Sequence
  Description of Artificial Sequence: Synthetic peptide
  XENP018678 vhCDR2
EIRLKSNNYATHYAEPVKG

SEQ ID NO: 7957 - protein, 11 aa, Artificial Sequence
  Description of Artificial Sequence: Synthetic peptide
  XENP018678 vhCDR3
YLGNYGGYFDV

SEQ ID NO: 7958 - protein, 11 aa, Artificial Sequence
  Description of Artificial Sequence: Synthetic peptide
  XENP018678 vlCDR1
RASQSVSNDVA

SEQ ID NO: 7959 - protein, 7 aa, Artificial Sequence
  Description of Artificial Sequence: Synthetic peptide
  XENP018678 vlCDR2
YASHRYT

SEQ ID NO: 7960 - protein, 9 aa, Artificial Sequence
  Description of Artificial Sequence: Synthetic peptide
  XENP018678 vlCDR3
QQDYSSPRT

SEQ ID NO: 7961 - protein, 249 aa, Artificial Sequence
  Description of Artificial Sequence: Synthetic polypeptide
  XENP018679 1G6_H1.179_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYWGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7962 - protein, 122 aa, Artificial Sequence
  Description of Artificial Sequence: Synthetic polypeptide
  VH of XENP018679
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYWGNYGGYFDVWGAGTLVTVSS

SEQ ID NO: 7963 - protein, 107 aa, Artificial Sequence; identical to SEQ ID NO: 6247
  Description of Artificial Sequence: Synthetic polypeptide
  VL of XENP018679

SEQ ID NO: 7964 - protein, 5 aa, Artificial Sequence
  Description of Artificial Sequence: Synthetic peptide
  XENP018679 vhCDR1
NYWMN

SEQ ID NO: 7965 - protein, 19 aa, Artificial Sequence
  Description of Artificial Sequence: Synthetic peptide
  XENP018679 vhCDR2
EIRLKSNNYATHYAEPVKG

SEQ ID NO: 7966 - protein, 11 aa, Artificial Sequence
  Description of Artificial Sequence: Synthetic peptide
  XENP018679 vhCDR3
YWGNYGGYFDV

SEQ ID NO: 7967 - protein, 11 aa, Artificial Sequence
  Description of Artificial Sequence: Synthetic peptide
  XENP018679 vlCDR1
RASQSVSNDVA

SEQ ID NO: 7968 - protein, 7 aa, Artificial Sequence
  Description of Artificial Sequence: Synthetic peptide
  XENP018679 vlCDR2
YASHRYT

SEQ ID NO: 7969 - protein, 9 aa, Artificial Sequence
  Description of Artificial Sequence: Synthetic peptide
  XENP018679 vlCDR3
QQDYSSPRT

SEQ ID NO: 7970 - protein, 249 aa, Artificial Sequence
  Description of Artificial Sequence: Synthetic polypeptide
  XENP018680 1G6_H1.180_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYVGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7971 - protein, 122 aa, Artificial Sequence
  Description of Artificial Sequence: Synthetic polypeptide
  VH of XENP018680
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYVGNYGGYFDVWGAGTLVTVSS

SEQ ID NO: 7972 - protein, 107 aa, Artificial Sequence; identical to SEQ ID NO: 6247
  Description of Artificial Sequence: Synthetic polypeptide
  VL of XENP018680

SEQ ID NO: 7973 - protein, 5 aa, Artificial Sequence
  Description of Artificial Sequence: Synthetic peptide
  XENP018680 vhCDR1
NYWMN

SEQ ID NO: 7974 - protein, 19 aa, Artificial Sequence
  Description of Artificial Sequence: Synthetic peptide
  XENP018680 vhCDR2
EIRLKSNNYATHYAEPVKG

SEQ ID NO: 7975 - protein, 11 aa, Artificial Sequence
  Description of Artificial Sequence: Synthetic peptide
  XENP018680 vhCDR3
YVGNYGGYFDV

SEQ ID NO: 7976 - protein, 11 aa, Artificial Sequence
  Description of Artificial Sequence: Synthetic peptide
  XENP018680 vlCDR1
RASQSVSNDVA

SEQ ID NO: 7977 - protein, 7 aa, Artificial Sequence
  Description of Artificial Sequence: Synthetic peptide
  XENP018680 vlCDR2
YASHRYT

SEQ ID NO: 7978 - protein, 9 aa, Artificial Sequence
  Description of Artificial Sequence: Synthetic peptide
  XENP018680 vlCDR3
QQDYSSPRT

SEQ ID NO: 7979 - protein, 249 aa, Artificial Sequence
  Description of Artificial Sequence: Synthetic polypeptide
  XENP018681 1G6_H1.181_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYAGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7980 - protein, 122 aa, Artificial Sequence
  Description of Artificial Sequence: Synthetic polypeptide
  VH of XENP018681
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYAGNYGGYFDVWGAGTLVTVSS

SEQ ID NO: 7981 - protein, 107 aa, Artificial Sequence; identical to SEQ ID NO: 6247
  Description of Artificial Sequence: Synthetic polypeptide
  VL of XENP018681

SEQ ID NO: 7982 - protein, 5 aa, Artificial Sequence
  Description of Artificial Sequence: Synthetic peptide
  XENP018681 vhCDR1
NYWMN

SEQ ID NO: 7983 - protein, 19 aa, Artificial Sequence
  Description of Artificial Sequence: Synthetic peptide
  XENP018681 vhCDR2
EIRLKSNNYATHYAEPVKG

SEQ ID NO: 7984 - protein, 11 aa, Artificial Sequence
  Description of Artificial Sequence: Synthetic peptide
  XENP018681 vhCDR3
YAGNYGGYFDV

SEQ ID NO: 7985 - protein, 11 aa, Artificial Sequence
  Description of Artificial Sequence: Synthetic peptide
  XENP018681 vlCDR1
RASQSVSNDVA

SEQ ID NO: 7986 - protein, 7 aa, Artificial Sequence
  Description of Artificial Sequence: Synthetic peptide
  XENP018681 vlCDR2
YASHRYT

SEQ ID NO: 7987 - protein, 9 aa, Artificial Sequence
  Description of Artificial Sequence: Synthetic peptide
  XENP018681 vlCDR3
QQDYSSPRT

SEQ ID NO: 7988 - protein, 249 aa, Artificial Sequence
  Description of Artificial Sequence: Synthetic polypeptide
  XENP018682 1G6_H1.182_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYQGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7989 - protein, 122 aa, Artificial Sequence
  Description of Artificial Sequence: Synthetic polypeptide
  VH of XENP018682
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYQGNYGGYFDVWGAGTLVTVSS

SEQ ID NO: 7990 - protein, 107 aa, Artificial Sequence; identical to SEQ ID NO: 6247
  Description of Artificial Sequence: Synthetic polypeptide
  VL of XENP018682

SEQ ID NO: 7991 - protein, 5 aa, Artificial Sequence
  Description of Artificial Sequence: Synthetic peptide
  XENP018682 vhCDR1
NYWMN

SEQ ID NO: 7992 - protein, 19 aa, Artificial Sequence
  Description of Artificial Sequence: Synthetic peptide
  XENP018682 vhCDR2
EIRLKSNNYATHYAEPVKG

SEQ ID NO: 7993 - protein, 11 aa, Artificial Sequence
  Description of Artificial Sequence: Synthetic peptide
  XENP018682 vhCDR3
YQGNYGGYFDV

SEQ ID NO: 7994 - protein, 11 aa, Artificial Sequence
  Description of Artificial Sequence: Synthetic peptide
  XENP018682 vlCDR1
RASQSVSNDVA

SEQ ID NO: 7995 - protein, 7 aa, Artificial Sequence
  Description of Artificial Sequence: Synthetic peptide
  XENP018682 vlCDR2
YASHRYT

SEQ ID NO: 7996 - protein, 9 aa, Artificial Sequence
  Description of Artificial Sequence: Synthetic peptide
  XENP018682 vlCDR3
QQDYSSPRT

SEQ ID NO: 7997 - protein, 249 aa, Artificial Sequence
  Description of Artificial Sequence: Synthetic polypeptide
  XENP018683 1G6_H1.183_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYDGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 7998 - protein, 122 aa, Artificial Sequence
  Description of Artificial Sequence: Synthetic polypeptide
  VH of XENP018683
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYDGNYGGYFDVWGAGTLVTVSS

SEQ ID NO: 7999 - protein, 107 aa, Artificial Sequence; identical to SEQ ID NO: 6247
  Description of Artificial Sequence: Synthetic polypeptide
  VL of XENP018683

SEQ ID NO: 8000 - protein, 5 aa, Artificial Sequence
  Description of Artificial Sequence: Synthetic peptide
  XENP018683 vhCDR1
NYWMN

SEQ ID NO: 8001 - protein, 19 aa, Artificial Sequence
  Description of Artificial Sequence: Synthetic peptide
  XENP018683 vhCDR2
EIRLKSNNYATHYAEPVKG

SEQ ID NO: 8002 - protein, 11 aa, Artificial Sequence
  Description of Artificial Sequence: Synthetic peptide
  XENP018683 vhCDR3
YDGNYGGYFDV

SEQ ID NO: 8003 - protein, 11 aa, Artificial Sequence
  Description of Artificial Sequence: Synthetic peptide
  XENP018683 vlCDR1
RASQSVSNDVA

SEQ ID NO: 8004 - protein, 7 aa, Artificial Sequence
  Description of Artificial Sequence: Synthetic peptide
  XENP018683 vlCDR2
YASHRYT

SEQ ID NO: 8005 - protein, 9 aa, Artificial Sequence
  Description of Artificial Sequence: Synthetic peptide
  XENP018683 vlCDR3
QQDYSSPRT

SEQ ID NO: 8006 - protein, 249 aa, Artificial Sequence
  Description of Artificial Sequence: Synthetic polypeptide
  XENP018684 1G6_H1.184_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYKGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8007 - protein, 122 aa, Artificial Sequence
  Description of Artificial Sequence: Synthetic polypeptide
  VH of XENP018684
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYKGNYGGYFDVWGAGTLVTVSS

SEQ ID NO: 8008 - protein, 107 aa, Artificial Sequence; identical to SEQ ID NO: 6247
  Description of Artificial Sequence: Synthetic polypeptide
  VL of XENP018684

SEQ ID NO: 8009 - protein, 5 aa, Artificial Sequence
  Description of Artificial Sequence: Synthetic peptide
  XENP018684 vhCDR1
NYWMN

SEQ ID NO: 8010 - protein, 19 aa, Artificial Sequence
  Description of Artificial Sequence: Synthetic peptide
  XENP018684 vhCDR2
EIRLKSNNYATHYAEPVKG

SEQ ID NO: 8011 - protein, 11 aa, Artificial Sequence
  Description of Artificial Sequence: Synthetic peptide
  XENP018684 vhCDR3
YKGNYGGYFDV

SEQ ID NO: 8012 - protein, 11 aa, Artificial Sequence
  Description of Artificial Sequence: Synthetic peptide
  XENP018684 vlCDR1
RASQSVSNDVA

SEQ ID NO: 8013 - protein, 7 aa, Artificial Sequence
  Description of Artificial Sequence: Synthetic peptide
  XENP018684 vlCDR2
YASHRYT

SEQ ID NO: 8014 - protein, 9 aa, Artificial Sequence
  Description of Artificial Sequence: Synthetic peptide
  XENP018684 vlCDR3
QQDYSSPRT

SEQ ID NO: 8015 - protein, 249 aa, Artificial Sequence
  Description of Artificial Sequence: Synthetic polypeptide
  XENP018685 1G6_H1.185_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYANYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8016 - protein, 122 aa, Artificial Sequence
  Description of Artificial Sequence: Synthetic polypeptide
  VH of XENP018685
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYANYGGYFDVWGAGTLVTVSS

SEQ ID NO: 8017 - protein, 107 aa, Artificial Sequence; identical to SEQ ID NO: 6247
  Description of Artificial Sequence: Synthetic polypeptide
  VL of XENP018685

SEQ ID NO: 8018 - protein, 5 aa, Artificial Sequence
  Description of Artificial Sequence: Synthetic peptide
  XENP018685 vhCDR1
NYWMN

SEQ ID NO: 8019 - protein, 19 aa, Artificial Sequence
  Description of Artificial Sequence: Synthetic peptide
  XENP018685 vhCDR2
EIRLKSNNYATHYAEPVKG

SEQ ID NO: 8020 - protein, 11 aa, Artificial Sequence
  Description of Artificial Sequence: Synthetic peptide
  XENP018685 vhCDR3
YYANYGGYFDV

SEQ ID NO: 8021 - protein, 11 aa, Artificial Sequence
  Description of Artificial Sequence: Synthetic peptide
  XENP018685 vlCDR1
RASQSVSNDVA

SEQ ID NO: 8022 - protein, 7 aa, Artificial Sequence
  Description of Artificial Sequence: Synthetic peptide
  XENP018685 vlCDR2
YASHRYT

SEQ ID NO: 8023 - protein, 9 aa, Artificial Sequence
  Description of Artificial Sequence: Synthetic peptide
  XENP018685 vlCDR3
QQDYSSPRT

SEQ ID NO: 8024 - protein, 249 aa, Artificial Sequence
  Description of Artificial Sequence: Synthetic polypeptide
  XENP018686 1G6_H1.186_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYSNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8025 - protein, 122 aa, Artificial Sequence
  Description of Artificial Sequence: Synthetic polypeptide
  VH of XENP018686
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYSNYGGYFDVWGAGTLVTVSS

SEQ ID NO: 8026 - protein, 107 aa, Artificial Sequence; identical to SEQ ID NO: 6247
  Description of Artificial Sequence: Synthetic polypeptide
  VL of XENP018686

SEQ ID NO: 8027 - protein, 5 aa, Artificial Sequence
  Description of Artificial Sequence: Synthetic peptide
  XENP018686 vhCDR1
NYWMN

SEQ ID NO: 8028 - protein, 19 aa, Artificial Sequence
  Description of Artificial Sequence: Synthetic peptide
  XENP018686 vhCDR2
EIRLKSNNYATHYAEPVKG

SEQ ID NO: 8029 - protein, 11 aa, Artificial Sequence
  Description of Artificial Sequence: Synthetic peptide
  XENP018686 vhCDR3
YYSNYGGYFDV

SEQ ID NO: 8030 - protein, 11 aa, Artificial Sequence
  Description of Artificial Sequence: Synthetic peptide
  XENP018686 vlCDR1
RASQSVSNDVA

SEQ ID NO: 8031 - protein, 7 aa, Artificial Sequence
  Description of Artificial Sequence: Synthetic peptide
  XENP018686 vlCDR2
YASHRYT

SEQ ID NO: 8032 - protein, 9 aa, Artificial Sequence
  Description of Artificial Sequence: Synthetic peptide
  XENP018686 vlCDR3
QQDYSSPRT

SEQ ID NO: 8033 - protein, 249 aa, Artificial Sequence
  Description of Artificial Sequence: Synthetic polypeptide
  XENP018687 1G6_H1.187_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYTNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8034 - protein, 122 aa, Artificial Sequence
  Description of Artificial Sequence: Synthetic polypeptide
  VH of XENP018687
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYTNYGGYFDVWGAGTLVTVSS

SEQ ID NO: 8035 - protein, 107 aa, Artificial Sequence; identical to SEQ ID NO: 6247
  Description of Artificial Sequence: Synthetic polypeptide
  VL of XENP018687

SEQ ID NO: 8036 - protein, 5 aa, Artificial Sequence
  Description of Artificial Sequence: Synthetic peptide
  XENP018687 vhCDR1
NYWMN

SEQ ID NO: 8037 - protein, 19 aa, Artificial Sequence
  Description of Artificial Sequence: Synthetic peptide
  XENP018687 vhCDR2
EIRLKSNNYATHYAEPVKG

SEQ ID NO: 8038 - protein, 11 aa, Artificial Sequence
  Description of Artificial Sequence: Synthetic peptide
  XENP018687 vhCDR3
YYTNYGGYFDV

SEQ ID NO: 8039 - protein, 11 aa, Artificial Sequence
  Description of Artificial Sequence: Synthetic peptide
  XENP018687 vlCDR1
RASQSVSNDVA

SEQ ID NO: 8040 - protein, 7 aa, Artificial Sequence
  Description of Artificial Sequence: Synthetic peptide
  XENP018687 vlCDR2
YASHRYT

SEQ ID NO: 8041 - protein, 9 aa, Artificial Sequence
  Description of Artificial Sequence: Synthetic peptide
  XENP018687 vlCDR3
QQDYSSPRT

SEQ ID NO: 8042 - protein, 249 aa, Artificial Sequence
  Description of Artificial Sequence: Synthetic polypeptide
  XENP018688 1G6_H1.188_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYQNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8043 - protein, 122 aa, Artificial Sequence
  Description of Artificial Sequence: Synthetic polypeptide
  VH of XENP018688
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYQNYGGYFDVWGAGTLVTVSS

SEQ ID NO: 8044 - protein, 107 aa, Artificial Sequence; identical to SEQ ID NO: 6247
  Description of Artificial Sequence: Synthetic polypeptide
  VL of XENP018688

SEQ ID NO: 8045 - protein, 5 aa, Artificial Sequence
  Description of Artificial Sequence: Synthetic peptide
  XENP018688 vhCDR1
NYWMN

SEQ ID NO: 8046 - protein, 19 aa, Artificial Sequence
  Description of Artificial Sequence: Synthetic peptide
  XENP018688 vhCDR2
EIRLKSNNYATHYAEPVKG

SEQ ID NO: 8047 - protein, 11 aa, Artificial Sequence
  Description of Artificial Sequence: Synthetic peptide
  XENP018688 vhCDR3
YYQNYGGYFDV

SEQ ID NO: 8048 - protein, 11 aa, Artificial Sequence
  Description of Artificial Sequence: Synthetic peptide
  XENP018688 vlCDR1
RASQSVSNDVA

SEQ ID NO: 8049 - protein, 7 aa, Artificial Sequence
  Description of Artificial Sequence: Synthetic peptide
  XENP018688 vlCDR2
YASHRYT

SEQ ID NO: 8050 - protein, 9 aa, Artificial Sequence
  Description of Artificial Sequence: Synthetic peptide
  XENP018688 vlCDR3
QQDYSSPRT

SEQ ID NO: 8051 - protein, 249 aa, Artificial Sequence
  Description of Artificial Sequence: Synthetic polypeptide
  XENP018689 1G6_H1.189_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYHNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8052 - protein, 122 aa, Artificial Sequence
  Description of Artificial Sequence: Synthetic polypeptide
  VH of XENP018689
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYHNYGGYFDVWGAGTLVTVSS

SEQ ID NO: 8053 - protein, 107 aa, Artificial Sequence; identical to SEQ ID NO: 6247
  Description of Artificial Sequence: Synthetic polypeptide
  VL of XENP018689

SEQ ID NO: 8054 - protein, 5 aa, Artificial Sequence
  Description of Artificial Sequence: Synthetic peptide
  XENP018689 vhCDR1
NYWMN

SEQ ID NO: 8055 - protein, 19 aa, Artificial Sequence
  Description of Artificial Sequence: Synthetic peptide
  XENP018689 vhCDR2
EIRLKSNNYATHYAEPVKG

SEQ ID NO: 8056 - protein, 11 aa, Artificial Sequence
  Description of Artificial Sequence: Synthetic peptide
  XENP018689 vhCDR3
YYHNYGGYFDV

SEQ ID NO: 8057 - protein, 11 aa, Artificial Sequence
  Description of Artificial Sequence: Synthetic peptide
  XENP018689 vlCDR1
RASQSVSNDVA

SEQ ID NO: 8058 - protein, 7 aa, Artificial Sequence
  Description of Artificial Sequence: Synthetic peptide
  XENP018689 vlCDR2
YASHRYT

SEQ ID NO: 8059 - protein, 9 aa, Artificial Sequence
  Description of Artificial Sequence: Synthetic peptide
  XENP018689 vlCDR3
QQDYSSPRT

SEQ ID NO: 8060 - protein, 249 aa, Artificial Sequence
  Description of Artificial Sequence: Synthetic polypeptide
  XENP018690 1G6_H1.190_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYDNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8061 - protein, 122 aa, Artificial Sequence
  Description of Artificial Sequence: Synthetic polypeptide
  VH of XENP018690
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYDNYGGYFDVWGAGTLVTVSS

SEQ ID NO: 8062 - protein, 107 aa, Artificial Sequence; identical to SEQ ID NO: 6247
  Description of Artificial Sequence: Synthetic polypeptide
  VL of XENP018690

SEQ ID NO: 8063 - protein, 5 aa, Artificial Sequence
  Description of Artificial Sequence: Synthetic peptide
  XENP018690 vhCDR1
NYWMN

SEQ ID NO: 8064 - protein, 19 aa, Artificial Sequence
  Description of Artificial Sequence: Synthetic peptide
  XENP018690 vhCDR2
EIRLKSNNYATHYAEPVKG

SEQ ID NO: 8065 - protein, 11 aa, Artificial Sequence
  Description of Artificial Sequence: Synthetic peptide
  XENP018690 vhCDR3
YYDNYGGYFDV

SEQ ID NO: 8066 - protein, 11 aa, Artificial Sequence
  Description of Artificial Sequence: Synthetic peptide
  XENP018690 vlCDR1
RASQSVSNDVA

SEQ ID NO: 8067 - protein, 7 aa, Artificial Sequence
  Description of Artificial Sequence: Synthetic peptide
  XENP018690 vlCDR2
YASHRYT

SEQ ID NO: 8068 - protein, 9 aa, Artificial Sequence
  Description of Artificial Sequence: Synthetic peptide
  XENP018690 vlCDR3
QQDYSSPRT

SEQ ID NO: 8069 - protein, 249 aa, Artificial Sequence
  Description of Artificial Sequence: Synthetic polypeptide
  XENP018691 1G6_H1.191_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYKNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8070 - protein, 122 aa, Artificial Sequence
  Description of Artificial Sequence: Synthetic polypeptide
  VH of XENP018691
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYKNYGGYFDVWGAGTLVTVSS

SEQ ID NO: 8071 - protein, 107 aa, Artificial Sequence; identical to SEQ ID NO: 6247
  Description of Artificial Sequence: Synthetic polypeptide
  VL of XENP018691

SEQ ID NO: 8072 - protein, 5 aa, Artificial Sequence
  Description of Artificial Sequence: Synthetic peptide
  XENP018691 vhCDR1
NYWMN

SEQ ID NO: 8073 - protein, 19 aa, Artificial Sequence
  Description of Artificial Sequence: Synthetic peptide
  XENP018691 vhCDR2
EIRLKSNNYATHYAEPVKG

SEQ ID NO: 8074 - protein, 11 aa, Artificial Sequence
  Description of Artificial Sequence: Synthetic peptide
  XENP018691 vhCDR3
YYKNYGGYFDV

SEQ ID NO: 8075 - protein, 11 aa, Artificial Sequence
  Description of Artificial Sequence: Synthetic peptide
  XENP018691 vlCDR1
RASQSVSNDVA

SEQ ID NO: 8076 - protein, 7 aa, Artificial Sequence
  Description of Artificial Sequence: Synthetic peptide
  XENP018691 vlCDR2
YASHRYT

SEQ ID NO: 8077 - protein, 9 aa, Artificial Sequence
  Description of Artificial Sequence: Synthetic peptide
  XENP018691 vlCDR3
QQDYSSPRT

SEQ ID NO: 8078 - protein, 249 aa, Artificial Sequence
  Description of Artificial Sequence: Synthetic polypeptide
  XENP018692 1G6_H1.192_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYLNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8079 - protein, 122 aa, Artificial Sequence
  Description of Artificial Sequence: Synthetic polypeptide
  VH of XENP018692
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYLNYGGYFDVWGAGTLVTVSS

SEQ ID NO: 8080 - protein, 107 aa, Artificial Sequence; identical to SEQ ID NO: 6247
  Description of Artificial Sequence: Synthetic polypeptide
  VL of XENP018692

SEQ ID NO: 8081 - protein, 5 aa, Artificial Sequence
  Description of Artificial Sequence: Synthetic peptide
  XENP018692 vhCDR1
NYWMN

SEQ ID NO: 8082 - protein, 19 aa, Artificial Sequence
  Description of Artificial Sequence: Synthetic peptide
  XENP018692 vhCDR2
EIRLKSNNYATHYAEPVKG

SEQ ID NO: 8083 - protein, 11 aa, Artificial Sequence
  Description of Artificial Sequence: Synthetic peptide
  XENP018692 vhCDR3
YYLNYGGYFDV

SEQ ID NO: 8084 - protein, 11 aa, Artificial Sequence
  Description of Artificial Sequence: Synthetic peptide
  XENP018692 vlCDR1
RASQSVSNDVA

SEQ ID NO: 8085 - protein, 7 aa, Artificial Sequence
  Description of Artificial Sequence: Synthetic peptide
  XENP018692 vlCDR2
YASHRYT

SEQ ID NO: 8086 - protein, 9 aa, Artificial Sequence
  Description of Artificial Sequence: Synthetic peptide
  XENP018692 vlCDR3
QQDYSSPRT

SEQ ID NO: 8087 - protein, 249 aa, Artificial Sequence
  Description of Artificial Sequence: Synthetic polypeptide
  XENP018693 1G6_H1.193_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYFNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8088 - protein, 122 aa, Artificial Sequence
  Description of Artificial Sequence: Synthetic polypeptide
  VH of XENP018693
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYFNYGGYFDVWGAGTLVTVSS

SEQ ID NO: 8089 - protein, 107 aa, Artificial Sequence; identical to SEQ ID NO: 6247
  Description of Artificial Sequence: Synthetic polypeptide
  VL of XENP018693

SEQ ID NO: 8090 - protein, 5 aa, Artificial Sequence
  Description of Artificial Sequence: Synthetic peptide
  XENP018693 vhCDR1
NYWMN

SEQ ID NO: 8091 - protein, 19 aa, Artificial Sequence
  Description of Artificial Sequence: Synthetic peptide
  XENP018693 vhCDR2
EIRLKSNNYATHYAEPVKG

SEQ ID NO: 8092 - protein, 11 aa, Artificial Sequence
  Description of Artificial Sequence: Synthetic peptide
  XENP018693 vhCDR3
YYFNYGGYFDV

SEQ ID NO: 8093 - protein, 11 aa, Artificial Sequence
  Description of Artificial Sequence: Synthetic peptide
  XENP018693 vlCDR1
RASQSVSNDVA

SEQ ID NO: 8094 - protein, 7 aa, Artificial Sequence
  Description of Artificial Sequence: Synthetic peptide
  XENP018693 vlCDR2
YASHRYT

SEQ ID NO: 8095 - protein, 9 aa, Artificial Sequence
  Description of Artificial Sequence: Synthetic peptide
  XENP018693 vlCDR3
QQDYSSPRT

SEQ ID NO: 8096 - protein, 249 aa, Artificial Sequence
  Description of Artificial Sequence: Synthetic polypeptide
  XENP018694 1G6_H1.194_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGDYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8097 - protein, 122 aa, Artificial Sequence
  Description of Artificial Sequence: Synthetic polypeptide
  VH of XENP018694
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGDYGGYFDVWGAGTLVTVSS

SEQ ID NO: 8098 - protein, 107 aa, Artificial Sequence; identical to SEQ ID NO: 6247
  Description of Artificial Sequence: Synthetic polypeptide
  VL of XENP018694

SEQ ID NO: 8099 - protein, 5 aa, Artificial Sequence
  Description of Artificial Sequence: Synthetic peptide
  XENP018694 vhCDR1
NYWMN

SEQ ID NO: 8100 - protein, 19 aa, Artificial Sequence
  Description of Artificial Sequence: Synthetic peptide
  XENP018694 vhCDR2
EIRLKSNNYATHYAEPVKG

SEQ ID NO: 8101 - protein, 11 aa, Artificial Sequence
  Description of Artificial Sequence: Synthetic peptide
  XENP018694 vhCDR3
YYGDYGGYFDV

SEQ ID NO: 8102 - protein, 11 aa, Artificial Sequence
  Description of Artificial Sequence: Synthetic peptide
  XENP018694 vlCDR1
RASQSVSNDVA

SEQ ID NO: 8103 - protein, 7 aa, Artificial Sequence
  Description of Artificial Sequence: Synthetic peptide
  XENP018694 vlCDR2
YASHRYT

SEQ ID NO: 8104 - protein, 9 aa, Artificial Sequence
  Description of Artificial Sequence: Synthetic peptide
  XENP018694 vlCDR3
QQDYSSPRT

SEQ ID NO: 8105 - protein, 249 aa, Artificial Sequence
  Description of Artificial Sequence: Synthetic polypeptide
  XENP018695 1G6_H1.195_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGHYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8106 - protein, 122 aa, Artificial Sequence
  Description of Artificial Sequence: Synthetic polypeptide
  VH of XENP018695
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGHYGGYFDVWGAGTLVTVSS

SEQ ID NO: 8107 - protein, 107 aa, Artificial Sequence; identical to SEQ ID NO: 6247
  Description of Artificial Sequence: Synthetic polypeptide
  VL of XENP018695

SEQ ID NO: 8108 - protein, 5 aa, Artificial Sequence
  Description of Artificial Sequence: Synthetic peptide
  XENP018695 vhCDR1
NYWMN

SEQ ID NO: 8109 - protein, 19 aa, Artificial Sequence
  Description of Artificial Sequence: Synthetic peptide
  XENP018695 vhCDR2
EIRLKSNNYATHYAEPVKG

SEQ ID NO: 8110 - protein, 11 aa, Artificial Sequence
  Description of Artificial Sequence: Synthetic peptide
  XENP018695 vhCDR3
YYGHYGGYFDV

SEQ ID NO: 8111 - protein, 11 aa, Artificial Sequence
  Description of Artificial Sequence: Synthetic peptide
  XENP018695 vlCDR1
RASQSVSNDVA

SEQ ID NO: 8112 - protein, 7 aa, Artificial Sequence
  Description of Artificial Sequence: Synthetic peptide
  XENP018695 vlCDR2
YASHRYT

SEQ ID NO: 8113 - protein, 9 aa, Artificial Sequence
  Description of Artificial Sequence: Synthetic peptide
  XENP018695 vlCDR3
QQDYSSPRT

SEQ ID NO: 8114 - protein, 249 aa, Artificial Sequence
  Description of Artificial Sequence: Synthetic polypeptide
  XENP018696 1G6_H1.196_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGEYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8115 - protein, 122 aa, Artificial Sequence
  Description of Artificial Sequence: Synthetic polypeptide
  VH of XENP018696
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGEYGGYFDVWGAGTLVTVSS

SEQ ID NO: 8116 - protein, 107 aa, Artificial Sequence; identical to SEQ ID NO: 6247
  Description of Artificial Sequence: Synthetic polypeptide
  VL of XENP018696

SEQ ID NO: 8117 - protein, 5 aa, Artificial Sequence
  Description of Artificial Sequence: Synthetic peptide
  XENP018696 vhCDR1
NYWMN

SEQ ID NO: 8118 - protein, 19 aa, Artificial Sequence
  Description of Artificial Sequence: Synthetic peptide
  XENP018696 vhCDR2
EIRLKSNNYATHYAEPVKG

SEQ ID NO: 8119 - protein, 11 aa, Artificial Sequence
  Description of Artificial Sequence: Synthetic peptide
  XENP018696 vhCDR3
YYGEYGGYFDV

SEQ ID NO: 8120 - protein, 11 aa, Artificial Sequence
  Description of Artificial Sequence: Synthetic peptide
  XENP018696 vlCDR1
RASQSVSNDVA

SEQ ID NO: 8121 - protein, 7 aa, Artificial Sequence
  Description of Artificial Sequence: Synthetic peptide
  XENP018696 vlCDR2
YASHRYT

SEQ ID NO: 8122 - protein, 9 aa, Artificial Sequence
  Description of Artificial Sequence: Synthetic peptide
  XENP018696 vlCDR3
QQDYSSPRT

SEQ ID NO: 8123 - protein, 249 aa, Artificial Sequence
  Description of Artificial Sequence: Synthetic polypeptide
  XENP018701 1G6_H1.197_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGSYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8124 - protein, 122 aa, Artificial Sequence
  Description of Artificial Sequence: Synthetic polypeptide
  VH of XENP018701
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGSYGGYFDVWGAGTLVTVSS

SEQ ID NO: 8125 - protein, 107 aa, Artificial Sequence; identical to SEQ ID NO: 6247
  Description of Artificial Sequence: Synthetic polypeptide
  VL of XENP018701

SEQ ID NO: 8126 - protein, 5 aa, Artificial Sequence
  Description of Artificial Sequence: Synthetic peptide
  XENP018701 vhCDR1
NYWMN

SEQ ID NO: 8127 - protein, 19 aa, Artificial Sequence
  Description of Artificial Sequence: Synthetic peptide
  XENP018701 vhCDR2
EIRLKSNNYATHYAEPVKG

SEQ ID NO: 8128 - protein, 11 aa, Artificial Sequence
  Description of Artificial Sequence: Synthetic peptide
  XENP018701 vhCDR3
YYGSYGGYFDV

SEQ ID NO: 8129 - protein, 11 aa, Artificial Sequence
  Description of Artificial Sequence: Synthetic peptide
  XENP018701 vlCDR1
RASQSVSNDVA

SEQ ID NO: 8130 - protein, 7 aa, Artificial Sequence
  Description of Artificial Sequence: Synthetic peptide
  XENP018701 vlCDR2
YASHRYT

SEQ ID NO: 8131 - protein, 9 aa, Artificial Sequence
  Description of Artificial Sequence: Synthetic peptide
  XENP018701 vlCDR3
QQDYSSPRT

SEQ ID NO: 8132 - protein, 249 aa, Artificial Sequence
  Description of Artificial Sequence: Synthetic polypeptide
  XENP018702 1G6_H1.198_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGRYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8133 - protein, 122 aa, Artificial Sequence
  Description of Artificial Sequence: Synthetic polypeptide
  VH of XENP018702
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGRYGGYFDVWGAGTLVTVSS

SEQ ID NO: 8134 - protein, 107 aa, Artificial Sequence; identical to SEQ ID NO: 6247
  Description of Artificial Sequence: Synthetic polypeptide
  VL of XENP018702

SEQ ID NO: 8135 - protein, 5 aa, Artificial Sequence
  Description of Artificial Sequence: Synthetic peptide
  XENP018702 vhCDR1
NYWMN

SEQ ID NO: 8136 - protein, 19 aa, Artificial Sequence
  Description of Artificial Sequence: Synthetic peptide
  XENP018702 vhCDR2
EIRLKSNNYATHYAEPVKG

SEQ ID NO: 8137 - protein, 11 aa, Artificial Sequence
  Description of Artificial Sequence: Synthetic peptide
  XENP018702 vhCDR3
YYGRYGGYFDV

SEQ ID NO: 8138 - protein, 11 aa, Artificial Sequence
  Description of Artificial Sequence: Synthetic peptide
  XENP018702 vlCDR1
RASQSVSNDVA

SEQ ID NO: 8139 - protein, 7 aa, Artificial Sequence
  Description of Artificial Sequence: Synthetic peptide
  XENP018702 vlCDR2
YASHRYT

SEQ ID NO: 8140 - protein, 9 aa, Artificial Sequence
  Description of Artificial Sequence: Synthetic peptide
  XENP018702 vlCDR3
QQDYSSPRT

SEQ ID NO: 8141 - protein, 249 aa, Artificial Sequence
  Description of Artificial Sequence: Synthetic polypeptide
  XENP018703 1G6_H1.199_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGLYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8142 - protein, 122 aa, Artificial Sequence
  Description of Artificial Sequence: Synthetic polypeptide
  VH of XENP018703
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGLYGGYFDVWGAGTLVTVSS

SEQ ID NO: 8143 - protein, 107 aa, Artificial Sequence; identical to SEQ ID NO: 6247
  Description of Artificial Sequence: Synthetic polypeptide
  VL of XENP018703

SEQ ID NO: 8144 - protein, 5 aa, Artificial Sequence
  Description of Artificial Sequence: Synthetic peptide
  XENP018703 vhCDR1
NYWMN

SEQ ID NO: 8145 - protein, 19 aa, Artificial Sequence
  Description of Artificial Sequence: Synthetic peptide
  XENP018703 vhCDR2
EIRLKSNNYATHYAEPVKG

SEQ ID NO: 8146 - protein, 11 aa, Artificial Sequence
  Description of Artificial Sequence: Synthetic peptide
  XENP018703 vhCDR3
YYGLYGGYFDV

SEQ ID NO: 8147 - protein, 11 aa, Artificial Sequence
  Description of Artificial Sequence: Synthetic peptide
  XENP018703 vlCDR1
RASQSVSNDVA

SEQ ID NO: 8148 - protein, 7 aa, Artificial Sequence
  Description of Artificial Sequence: Synthetic peptide
  XENP018703 vlCDR2
YASHRYT

SEQ ID NO: 8149 - protein, 9 aa, Artificial Sequence
  Description of Artificial Sequence: Synthetic peptide
  XENP018703 vlCDR3
QQDYSSPRT

SEQ ID NO: 8150 - protein, 249 aa, Artificial Sequence
  Description of Artificial Sequence: Synthetic polypeptide
  XENP018704 1G6_H1.200_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGTYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8151 - protein, 122 aa, Artificial Sequence
  Description of Artificial Sequence: Synthetic polypeptide
  VH of XENP018704
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGTYGGYFDVWGAGTLVTVSS

SEQ ID NO: 8152 - protein, 107 aa, Artificial Sequence; identical to SEQ ID NO: 6247
  Description of Artificial Sequence: Synthetic polypeptide
  VL of XENP018704

SEQ ID NO: 8153 - protein, 5 aa, Artificial Sequence
  Description of Artificial Sequence: Synthetic peptide
  XENP018704 vhCDR1
NYWMN

SEQ ID NO: 8154 - protein, 19 aa, Artificial Sequence
  Description of Artificial Sequence: Synthetic peptide
  XENP018704 vhCDR2
EIRLKSNNYATHYAEPVKG

SEQ ID NO: 8155 - protein, 11 aa, Artificial Sequence
  Description of Artificial Sequence: Synthetic peptide
  XENP018704 vhCDR3
YYGTYGGYFDV

SEQ ID NO: 8156 - protein, 11 aa, Artificial Sequence
  Description of Artificial Sequence: Synthetic peptide
  XENP018704 vlCDR1
RASQSVSNDVA

SEQ ID NO: 8157 - protein, 7 aa, Artificial Sequence
  Description of Artificial Sequence: Synthetic peptide
  XENP018704 vlCDR2
YASHRYT

SEQ ID NO: 8158 - protein, 9 aa, Artificial Sequence
  Description of Artificial Sequence: Synthetic peptide
  XENP018704 vlCDR3
QQDYSSPRT

SEQ ID NO: 8159 - protein, 249 aa, Artificial Sequence
  Description of Artificial Sequence: Synthetic polypeptide
  XENP018705 1G6_H1.201_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGGYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8160 - protein, 122 aa, Artificial Sequence
  Description of Artificial Sequence: Synthetic polypeptide
  VH of XENP018705
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGGYGGYFDVWGAGTLVTVSS

SEQ ID NO: 8161 - protein, 107 aa, Artificial Sequence; identical to SEQ ID NO: 6247
  Description of Artificial Sequence: Synthetic polypeptide
  VL of XENP018705

SEQ ID NO: 8162 - protein, 5 aa, Artificial Sequence
  Description of Artificial Sequence: Synthetic peptide
  XENP018705 vhCDR1
NYWMN

SEQ ID NO: 8163 - protein, 19 aa, Artificial Sequence
  Description of Artificial Sequence: Synthetic peptide
  XENP018705 vhCDR2
EIRLKSNNYATHYAEPVKG

SEQ ID NO: 8164 - protein, 11 aa, Artificial Sequence
  Description of Artificial Sequence: Synthetic peptide
  XENP018705 vhCDR3
YYGGYGGYFDV

SEQ ID NO: 8165 - protein, 11 aa, Artificial Sequence
  Description of Artificial Sequence: Synthetic peptide
  XENP018705 vlCDR1
RASQSVSNDVA

SEQ ID NO: 8166 - protein, 7 aa, Artificial Sequence
  Description of Artificial Sequence: Synthetic peptide
  XENP018705 vlCDR2
YASHRYT

SEQ ID NO: 8167 - protein, 9 aa, Artificial Sequence
  Description of Artificial Sequence: Synthetic peptide
  XENP018705 vlCDR3
QQDYSSPRT

SEQ ID NO: 8168 - protein, 249 aa, Artificial Sequence
  Description of Artificial Sequence: Synthetic polypeptide
  XENP018706 1G6_H1.202_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGFYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8169 - protein, 122 aa, Artificial Sequence
  Description of Artificial Sequence: Synthetic polypeptide
  VH of XENP018706
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGFYGGYFDVWGAGTLVTVSS

SEQ ID NO: 8170 - protein, 107 aa, Artificial Sequence; identical to SEQ ID NO: 6247
  Description of Artificial Sequence: Synthetic polypeptide
  VL of XENP018706

SEQ ID NO: 8171 - protein, 5 aa, Artificial Sequence
  Description of Artificial Sequence: Synthetic peptide
  XENP018706 vhCDR1
NYWMN

SEQ ID NO: 8172 - protein, 19 aa, Artificial Sequence
  Description of Artificial Sequence: Synthetic peptide
  XENP018706 vhCDR2
EIRLKSNNYATHYAEPVKG

SEQ ID NO: 8173 - protein, 11 aa, Artificial Sequence
  Description of Artificial Sequence: Synthetic peptide
  XENP018706 vhCDR3
YYGFYGGYFDV

SEQ ID NO: 8174 - protein, 11 aa, Artificial Sequence
  Description of Artificial Sequence: Synthetic peptide
  XENP018706 vlCDR1
RASQSVSNDVA

SEQ ID NO: 8175 - protein, 7 aa, Artificial Sequence
  Description of Artificial Sequence: Synthetic peptide
  XENP018706 vlCDR2
YASHRYT

SEQ ID NO: 8176 - protein, 9 aa, Artificial Sequence
  Description of Artificial Sequence: Synthetic peptide
  XENP018706 vlCDR3
QQDYSSPRT

SEQ ID NO: 8177 - protein, 249 aa, Artificial Sequence
  Description of Artificial Sequence: Synthetic polypeptide
  XENP018707 1G6_H1.203_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNFGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8178 - protein, 122 aa, Artificial Sequence
  Description of Artificial Sequence: Synthetic polypeptide
  VH of XENP018707
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNFGGYFDVWGAGTLVTVSS

SEQ ID NO: 8179 - protein, 107 aa, Artificial Sequence; identical to SEQ ID NO: 6247
  Description of Artificial Sequence: Synthetic polypeptide
  VL of XENP018707

SEQ ID NO: 8180 - protein, 5 aa, Artificial Sequence
  Description of Artificial Sequence: Synthetic peptide
  XENP018707 vhCDR1
NYWMN

SEQ ID NO: 8181 - protein, 19 aa, Artificial Sequence
  Description of Artificial Sequence: Synthetic peptide
  XENP018707 vhCDR2
EIRLKSNNYATHYAEPVKG

SEQ ID NO: 8182 - protein, 11 aa, Artificial Sequence
  Description of Artificial Sequence: Synthetic peptide
  XENP018707 vhCDR3
YYGNFGGYFDV

SEQ ID NO: 8183 - protein, 11 aa, Artificial Sequence
  Description of Artificial Sequence: Synthetic peptide
  XENP018707 vlCDR1
RASQSVSNDVA

SEQ ID NO: 8184 - protein, 7 aa, Artificial Sequence
  Description of Artificial Sequence: Synthetic peptide
  XENP018707 vlCDR2
YASHRYT

SEQ ID NO: 8185 - protein, 9 aa, Artificial Sequence
  Description of Artificial Sequence: Synthetic peptide
  XENP018707 vlCDR3
QQDYSSPRT

SEQ ID NO: 8186 - protein, 249 aa, Artificial Sequence
  Description of Artificial Sequence: Synthetic polypeptide
  XENP018708 1G6_H1.204_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNHGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8187 - protein, 122 aa, Artificial Sequence
  Description of Artificial Sequence: Synthetic polypeptide
  VH of XENP018708
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNHGGYFDVWGAGTLVTVSS

SEQ ID NO: 8188 - protein, 107 aa, Artificial Sequence; identical to SEQ ID NO: 6247
  Description of Artificial Sequence: Synthetic polypeptide
  VL of XENP018708

SEQ ID NO: 8189 - protein, 5 aa, Artificial Sequence
  Description of Artificial Sequence: Synthetic peptide
  XENP018708 vhCDR1
NYWMN

SEQ ID NO: 8190 - protein, 19 aa, Artificial Sequence
  Description of Artificial Sequence: Synthetic peptide
  XENP018708 vhCDR2
EIRLKSNNYATHYAEPVKG

SEQ ID NO: 8191 - protein, 11 aa, Artificial Sequence
  Description of Artificial Sequence: Synthetic peptide
  XENP018708 vhCDR3
YYGNHGGYFDV

SEQ ID NO: 8192 - protein, 11 aa, Artificial Sequence
  Description of Artificial Sequence: Synthetic peptide
  XENP018708 vlCDR1
RASQSVSNDVA

SEQ ID NO: 8193 - protein, 7 aa, Artificial Sequence
  Description of Artificial Sequence: Synthetic peptide
  XENP018708 vlCDR2
YASHRYT

SEQ ID NO: 8194 - protein, 9 aa, Artificial Sequence
  Description of Artificial Sequence: Synthetic peptide
  XENP018708 vlCDR3
QQDYSSPRT

SEQ ID NO: 8195 - protein, 249 aa, Artificial Sequence
  Description of Artificial Sequence: Synthetic polypeptide
  XENP018709 1G6_H1.205_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNLGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8196 - protein, 122 aa, Artificial Sequence
  Description of Artificial Sequence: Synthetic polypeptide
  VH of XENP018709
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNLGGYFDVWGAGTLVTVSS

SEQ ID NO: 8197 - protein, 107 aa, Artificial Sequence; identical to SEQ ID NO: 6247
  Description of Artificial Sequence: Synthetic polypeptide
  VL of XENP018709

SEQ ID NO: 8198 - protein, 5 aa, Artificial Sequence
  Description of Artificial Sequence: Synthetic peptide
  XENP018709 vhCDR1
NYWMN

SEQ ID NO: 8199 - protein, 19 aa, Artificial Sequence
  Description of Artificial Sequence: Synthetic peptide
  XENP018709 vhCDR2
EIRLKSNNYATHYAEPVKG

SEQ ID NO: 8200 - protein, 11 aa, Artificial Sequence
  Description of Artificial Sequence: Synthetic peptide
  XENP018709 vhCDR3
YYGNLGGYFDV

SEQ ID NO: 8201 - protein, 11 aa, Artificial Sequence
  Description of Artificial Sequence: Synthetic peptide
  XENP018709 vlCDR1
RASQSVSNDVA

SEQ ID NO: 8202 - protein, 7 aa, Artificial Sequence
  Description of Artificial Sequence: Synthetic peptide
  XENP018709 vlCDR2
YASHRYT

SEQ ID NO: 8203 - protein, 9 aa, Artificial Sequence
  Description of Artificial Sequence: Synthetic peptide
  XENP018709 vlCDR3
QQDYSSPRT

SEQ ID NO: 8204 - protein, 249 aa, Artificial Sequence
  Description of Artificial Sequence: Synthetic polypeptide
  XENP018710 1G6_H1.206_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNWGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8205 - protein, 122 aa, Artificial Sequence
  Description of Artificial Sequence: Synthetic polypeptide
  VH of XENP018710
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNWGGYFDVWGAGTLVTVSS

SEQ ID NO: 8206 - protein, 107 aa, Artificial Sequence; identical to SEQ ID NO: 6247
  Description of Artificial Sequence: Synthetic polypeptide
  VL of XENP018710

SEQ ID NO: 8207 - protein, 5 aa, Artificial Sequence
  Description of Artificial Sequence: Synthetic peptide
  XENP018710 vhCDR1
NYWMN

SEQ ID NO: 8208 - protein, 19 aa, Artificial Sequence
  Description of Artificial Sequence: Synthetic peptide
  XENP018710 vhCDR2
EIRLKSNNYATHYAEPVKG

SEQ ID NO: 8209 - protein, 11 aa, Artificial Sequence
  Description of Artificial Sequence: Synthetic peptide
  XENP018710 vhCDR3
YYGNWGGYFDV

SEQ ID NO: 8210 - protein, 11 aa, Artificial Sequence
  Description of Artificial Sequence: Synthetic peptide
  XENP018710 vlCDR1
RASQSVSNDVA

SEQ ID NO: 8211 - protein, 7 aa, Artificial Sequence
  Description of Artificial Sequence: Synthetic peptide
  XENP018710 vlCDR2
YASHRYT

SEQ ID NO: 8212 - protein, 9 aa, Artificial Sequence
  Description of Artificial Sequence: Synthetic peptide
  XENP018710 vlCDR3
QQDYSSPRT

SEQ ID NO: 8213 - protein, 249 aa, Artificial Sequence
  Description of Artificial Sequence: Synthetic polypeptide
  XENP018711 1G6_H1.207_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNVGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8214 - protein, 122 aa, Artificial Sequence
  Description of Artificial Sequence: Synthetic polypeptide
  VH of XENP018711
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNVGGYFDVWGAGTLVTVSS

SEQ ID NO: 8215 - protein, 107 aa, Artificial Sequence; identical to SEQ ID NO: 6247
  Description of Artificial Sequence: Synthetic polypeptide
  VL of XENP018711

SEQ ID NO: 8216 - protein, 5 aa, Artificial Sequence
  Description of Artificial Sequence: Synthetic peptide
  XENP018711 vhCDR1
NYWMN

SEQ ID NO: 8217 - protein, 19 aa, Artificial Sequence
  Description of Artificial Sequence: Synthetic peptide
  XENP018711 vhCDR2
EIRLKSNNYATHYAEPVKG

SEQ ID NO: 8218 - protein, 11 aa, Artificial Sequence
  Description of Artificial Sequence: Synthetic peptide
  XENP018711 vhCDR3
YYGNVGGYFDV

SEQ ID NO: 8219 - protein, 11 aa, Artificial Sequence
  Description of Artificial Sequence: Synthetic peptide
  XENP018711 vlCDR1
RASQSVSNDVA

SEQ ID NO: 8220 - protein, 7 aa, Artificial Sequence
  Description of Artificial Sequence: Synthetic peptide
  XENP018711 vlCDR2
YASHRYT

SEQ ID NO: 8221 - protein, 9 aa, Artificial Sequence
  Description of Artificial Sequence: Synthetic peptide
  XENP018711 vlCDR3
QQDYSSPRT

SEQ ID NO: 8222 - protein, 249 aa, Artificial Sequence
  Description of Artificial Sequence: Synthetic polypeptide
  XENP018712 1G6_H1.208_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNAGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8223 - protein, 122 aa, Artificial Sequence
  Description of Artificial Sequence: Synthetic polypeptide
  VH of XENP018712
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNAGGYFDVWGAGTLVTVSS

SEQ ID NO: 8224 - protein, 107 aa, Artificial Sequence; identical to SEQ ID NO: 6247
  Description of Artificial Sequence: Synthetic polypeptide
  VL of XENP018712

SEQ ID NO: 8225 - protein, 5 aa, Artificial Sequence
  Description of Artificial Sequence: Synthetic peptide
  XENP018712 vhCDR1
NYWMN

SEQ ID NO: 8226 - protein, 19 aa, Artificial Sequence
  Description of Artificial Sequence: Synthetic peptide
  XENP018712 vhCDR2
EIRLKSNNYATHYAEPVKG

SEQ ID NO: 8227 - protein, 11 aa, Artificial Sequence
  Description of Artificial Sequence: Synthetic peptide
  XENP018712 vhCDR3
YYGNAGGYFDV

SEQ ID NO: 8228 - protein, 11 aa, Artificial Sequence
  Description of Artificial Sequence: Synthetic peptide
  XENP018712 vlCDR1
RASQSVSNDVA

SEQ ID NO: 8229 - protein, 7 aa, Artificial Sequence
  Description of Artificial Sequence: Synthetic peptide
  XENP018712 vlCDR2
YASHRYT

SEQ ID NO: 8230 - protein, 9 aa, Artificial Sequence
  Description of Artificial Sequence: Synthetic peptide
  XENP018712 vlCDR3
QQDYSSPRT

SEQ ID NO: 8231 - protein, 249 aa, Artificial Sequence
  Description of Artificial Sequence: Synthetic polypeptide
  XENP018713 1G6_H1.209_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNQGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8232 - protein, 122 aa, Artificial Sequence
  Description of Artificial Sequence: Synthetic polypeptide
  VH of XENP018713
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNQGGYFDVWGAGTLVTVSS

SEQ ID NO: 8233 - protein, 107 aa, Artificial Sequence; identical to SEQ ID NO: 6247
  Description of Artificial Sequence: Synthetic polypeptide
  VL of XENP018713

SEQ ID NO: 8234 - protein, 5 aa, Artificial Sequence
  Description of Artificial Sequence: Synthetic peptide
  XENP018713 vhCDR1
NYWMN

SEQ ID NO: 8235 - protein, 19 aa, Artificial Sequence
  Description of Artificial Sequence: Synthetic peptide
  XENP018713 vhCDR2
EIRLKSNNYATHYAEPVKG

SEQ ID NO: 8236 - protein, 11 aa, Artificial Sequence
  Description of Artificial Sequence: Synthetic peptide
  XENP018713 vhCDR3
YYGNQGGYFDV

SEQ ID NO: 8237 - protein, 11 aa, Artificial Sequence
  Description of Artificial Sequence: Synthetic peptide
  XENP018713 vlCDR1
RASQSVSNDVA

SEQ ID NO: 8238 - protein, 7 aa, Artificial Sequence
  Description of Artificial Sequence: Synthetic peptide
  XENP018713 vlCDR2
YASHRYT

SEQ ID NO: 8239 - protein, 9 aa, Artificial Sequence
  Description of Artificial Sequence: Synthetic peptide
  XENP018713 vlCDR3
QQDYSSPRT

SEQ ID NO: 8240 - protein, 249 aa, Artificial Sequence
  Description of Artificial Sequence: Synthetic polypeptide
  XENP018714 1G6_H1.210_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNEGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8241 - protein, 122 aa, Artificial Sequence
  Description of Artificial Sequence: Synthetic polypeptide
  VH of XENP018714
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNEGGYFDVWGAGTLVTVSS

SEQ ID NO: 8242 - protein, 107 aa, Artificial Sequence; identical to SEQ ID NO: 6247
  Description of Artificial Sequence: Synthetic polypeptide
  VL of XENP018714

SEQ ID NO: 8243 - protein, 5 aa, Artificial Sequence
  Description of Artificial Sequence: Synthetic peptide
  XENP018714 vhCDR1
NYWMN

SEQ ID NO: 8244 - protein, 19 aa, Artificial Sequence
  Description of Artificial Sequence: Synthetic peptide
  XENP018714 vhCDR2
EIRLKSNNYATHYAEPVKG

SEQ ID NO: 8245 - protein, 11 aa, Artificial Sequence
  Description of Artificial Sequence: Synthetic peptide
  XENP018714 vhCDR3
YYGNEGGYFDV

SEQ ID NO: 8246 - protein, 11 aa, Artificial Sequence
  Description of Artificial Sequence: Synthetic peptide
  XENP018714 vlCDR1
RASQSVSNDVA

SEQ ID NO: 8247 - protein, 7 aa, Artificial Sequence
  Description of Artificial Sequence: Synthetic peptide
  XENP018714 vlCDR2
YASHRYT

SEQ ID NO: 8248 - protein, 9 aa, Artificial Sequence
  Description of Artificial Sequence: Synthetic peptide
  XENP018714 vlCDR3
QQDYSSPRT

SEQ ID NO: 8249 - protein, 249 aa, Artificial Sequence
  Description of Artificial Sequence: Synthetic polypeptide
  XENP018715 1G6_H1.211_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNKGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8250 - protein, 122 aa, Artificial Sequence
  Description of Artificial Sequence: Synthetic polypeptide
  VH of XENP018715
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNKGGYFDVWGAGTLVTVSS

SEQ ID NO: 8251 - protein, 107 aa, Artificial Sequence; identical to SEQ ID NO: 6247
  Description of Artificial Sequence: Synthetic polypeptide
  VL of XENP018715

SEQ ID NO: 8252 - protein, 5 aa, Artificial Sequence
  Description of Artificial Sequence: Synthetic peptide
  XENP018715 vhCDR1
NYWMN

SEQ ID NO: 8253 - protein, 19 aa, Artificial Sequence
  Description of Artificial Sequence: Synthetic peptide
  XENP018715 vhCDR2
EIRLKSNNYATHYAEPVKG

SEQ ID NO: 8254 - protein, 11 aa, Artificial Sequence
  Description of Artificial Sequence: Synthetic peptide
  XENP018715 vhCDR3
YYGNKGGYFDV

SEQ ID NO: 8255 - protein, 11 aa, Artificial Sequence
  Description of Artificial Sequence: Synthetic peptide
  XENP018715 vlCDR1
RASQSVSNDVA

SEQ ID NO: 8256 - protein, 7 aa, Artificial Sequence
  Description of Artificial Sequence: Synthetic peptide
  XENP018715 vlCDR2
YASHRYT

SEQ ID NO: 8257 - protein, 9 aa, Artificial Sequence
  Description of Artificial Sequence: Synthetic peptide
  XENP018715 vlCDR3
QQDYSSPRT

SEQ ID NO: 8258 - protein, 249 aa, Artificial Sequence
  Description of Artificial Sequence: Synthetic polypeptide
  XENP018716 1G6_H1.212_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYAGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8259 - protein, 122 aa, Artificial Sequence
  Description of Artificial Sequence: Synthetic polypeptide
  VH of XENP018716
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYAGYFDVWGAGTLVTVSS

SEQ ID NO: 8260 - protein, 107 aa, Artificial Sequence; identical to SEQ ID NO: 6247
  Description of Artificial Sequence: Synthetic polypeptide
  VL of XENP018716

SEQ ID NO: 8261 - protein, 5 aa, Artificial Sequence
  Description of Artificial Sequence: Synthetic peptide
  XENP018716 vhCDR1
NYWMN

SEQ ID NO: 8262 - protein, 19 aa, Artificial Sequence
  Description of Artificial Sequence: Synthetic peptide
  XENP018716 vhCDR2
EIRLKSNNYATHYAEPVKG

SEQ ID NO: 8263 - protein, 11 aa, Artificial Sequence
  Description of Artificial Sequence: Synthetic peptide
  XENP018716 vhCDR3
YYGNYAGYFDV

SEQ ID NO: 8264 - protein, 11 aa, Artificial Sequence
  Description of Artificial Sequence: Synthetic peptide
  XENP018716 vlCDR1
RASQSVSNDVA

SEQ ID NO: 8265 - protein, 7 aa, Artificial Sequence
  Description of Artificial Sequence: Synthetic peptide
  XENP018716 vlCDR2
YASHRYT

SEQ ID NO: 8266 - protein, 9 aa, Artificial Sequence
  Description of Artificial Sequence: Synthetic peptide
  XENP018716 vlCDR3
QQDYSSPRT

SEQ ID NO: 8267 - protein, 249 aa, Artificial Sequence
  Description of Artificial Sequence: Synthetic polypeptide
  XENP018717 1G6_H1.213_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYQGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8268 - protein, 122 aa, Artificial Sequence
  Description of Artificial Sequence: Synthetic polypeptide
  VH of XENP018717
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYQGYFDVWGAGTLVTVSS

SEQ ID NO: 8269 - protein, 107 aa, Artificial Sequence; identical to SEQ ID NO: 6247
  Description of Artificial Sequence: Synthetic polypeptide
  VL of XENP018717

SEQ ID NO: 8270 - protein, 5 aa, Artificial Sequence
  Description of Artificial Sequence: Synthetic peptide
  XENP018717 vhCDR1
NYWMN

SEQ ID NO: 8271 - protein, 19 aa, Artificial Sequence
  Description of Artificial Sequence: Synthetic peptide
  XENP018717 vhCDR2
EIRLKSNNYATHYAEPVKG

SEQ ID NO: 8272 - protein, 11 aa, Artificial Sequence
  Description of Artificial Sequence: Synthetic peptide
  XENP018717 vhCDR3
YYGNYQGYFDV

SEQ ID NO: 8273 - protein, 11 aa, Artificial Sequence
  Description of Artificial Sequence: Synthetic peptide
  XENP018717 vlCDR1
RASQSVSNDVA

SEQ ID NO: 8274 - protein, 7 aa, Artificial Sequence
  Description of Artificial Sequence: Synthetic peptide
  XENP018717 vlCDR2
YASHRYT

SEQ ID NO: 8275 - protein, 9 aa, Artificial Sequence
  Description of Artificial Sequence: Synthetic peptide
  XENP018717 vlCDR3
QQDYSSPRT

SEQ ID NO: 8276 - protein, 249 aa, Artificial Sequence
  Description of Artificial Sequence: Synthetic polypeptide
  XENP018718 1G6_H1.214_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYHGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8277 - protein, 122 aa, Artificial Sequence
  Description of Artificial Sequence: Synthetic polypeptide
  VH of XENP018718
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYHGYFDVWGAGTLVTVSS

SEQ ID NO: 8278 - protein, 107 aa, Artificial Sequence; identical to SEQ ID NO: 6247
  Description of Artificial Sequence: Synthetic polypeptide
  VL of XENP018718

SEQ ID NO: 8279 - protein, 5 aa, Artificial Sequence
  Description of Artificial Sequence: Synthetic peptide
  XENP018718 vhCDR1
NYWMN

SEQ ID NO: 8280 - protein, 19 aa, Artificial Sequence
  Description of Artificial Sequence: Synthetic peptide
  XENP018718 vhCDR2
EIRLKSNNYATHYAEPVKG

SEQ ID NO: 8281 - protein, 11 aa, Artificial Sequence
  Description of Artificial Sequence: Synthetic peptide
  XENP018718 vhCDR3
YYGNYHGYFDV

SEQ ID NO: 8282 - protein, 11 aa, Artificial Sequence
  Description of Artificial Sequence: Synthetic peptide
  XENP018718 vlCDR1
RASQSVSNDVA

SEQ ID NO: 8283 - protein, 7 aa, Artificial Sequence
  Description of Artificial Sequence: Synthetic peptide
  XENP018718 vlCDR2
YASHRYT

SEQ ID NO: 8284 - protein, 9 aa, Artificial Sequence
  Description of Artificial Sequence: Synthetic peptide
  XENP018718 vlCDR3
QQDYSSPRT

SEQ ID NO: 8285 - protein, 249 aa, Artificial Sequence
  Description of Artificial Sequence: Synthetic polypeptide
  XENP018719 1G6_H1.215_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYDGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8286 - protein, 122 aa, Artificial Sequence
  Description of Artificial Sequence: Synthetic polypeptide
  VH of XENP018719
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYDGYFDVWGAGTLVTVSS

SEQ ID NO: 8287 - protein, 107 aa, Artificial Sequence; identical to SEQ ID NO: 6247
  Description of Artificial Sequence: Synthetic polypeptide
  VL of XENP018719

SEQ ID NO: 8288 - protein, 5 aa, Artificial Sequence
  Description of Artificial Sequence: Synthetic peptide
  XENP018719 vhCDR1
NYWMN

SEQ ID NO: 8289 - protein, 19 aa, Artificial Sequence
  Description of Artificial Sequence: Synthetic peptide
  XENP018719 vhCDR2
EIRLKSNNYATHYAEPVKG

SEQ ID NO: 8290 - protein, 11 aa, Artificial Sequence
  Description of Artificial Sequence: Synthetic peptide
  XENP018719 vhCDR3
YYGNYDGYFDV

SEQ ID NO: 8291 - protein, 11 aa, Artificial Sequence
  Description of Artificial Sequence: Synthetic peptide
  XENP018719 vlCDR1
RASQSVSNDVA

SEQ ID NO: 8292 - protein, 7 aa, Artificial Sequence
  Description of Artificial Sequence: Synthetic peptide
  XENP018719 vlCDR2
YASHRYT

SEQ ID NO: 8293 - protein, 9 aa, Artificial Sequence
  Description of Artificial Sequence: Synthetic peptide
  XENP018719 vlCDR3
QQDYSSPRT

SEQ ID NO: 8294 - protein, 249 aa, Artificial Sequence
  Description of Artificial Sequence: Synthetic polypeptide
  XENP018720 1G6_H1.216_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYKGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8295 - protein, 122 aa, Artificial Sequence
  Description of Artificial Sequence: Synthetic polypeptide
  VH of XENP018720
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYKGYFDVWGAGTLVTVSS

SEQ ID NO: 8296 - protein, 107 aa, Artificial Sequence; identical to SEQ ID NO: 6247
  Description of Artificial Sequence: Synthetic polypeptide
  VL of XENP018720

SEQ ID NO: 8297 - protein, 5 aa, Artificial Sequence
  Description of Artificial Sequence: Synthetic peptide
  XENP018720 vhCDR1
NYWMN

SEQ ID NO: 8298 - protein, 19 aa, Artificial Sequence
  Description of Artificial Sequence: Synthetic peptide
  XENP018720 vhCDR2
EIRLKSNNYATHYAEPVKG

SEQ ID NO: 8299 - protein, 11 aa, Artificial Sequence
  Description of Artificial Sequence: Synthetic peptide
  XENP018720 vhCDR3
YYGNYKGYFDV

SEQ ID NO: 8300 - protein, 11 aa, Artificial Sequence
  Description of Artificial Sequence: Synthetic peptide
  XENP018720 vlCDR1
RASQSVSNDVA

SEQ ID NO: 8301 - protein, 7 aa, Artificial Sequence
  Description of Artificial Sequence: Synthetic peptide
  XENP018720 vlCDR2
YASHRYT

SEQ ID NO: 8302 - protein, 9 aa, Artificial Sequence
  Description of Artificial Sequence: Synthetic peptide
  XENP018720 vlCDR3
QQDYSSPRT

SEQ ID NO: 8303 - protein, 249 aa, Artificial Sequence
  Description of Artificial Sequence: Synthetic polypeptide
  XENP018721 1G6_H1.217_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYLGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8304 - protein, 122 aa, Artificial Sequence
  Description of Artificial Sequence: Synthetic polypeptide
  VH of XENP018721
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYLGYFDVWGAGTLVTVSS

SEQ ID NO: 8305 - protein, 107 aa, Artificial Sequence; identical to SEQ ID NO: 6247
  Description of Artificial Sequence: Synthetic polypeptide
  VL of XENP018721

SEQ ID NO: 8306 - protein, 5 aa, Artificial Sequence
  Description of Artificial Sequence: Synthetic peptide
  XENP018721 vhCDR1
NYWMN

SEQ ID NO: 8307 - protein, 19 aa, Artificial Sequence
  Description of Artificial Sequence: Synthetic peptide
  XENP018721 vhCDR2
EIRLKSNNYATHYAEPVKG

SEQ ID NO: 8308 - protein, 11 aa, Artificial Sequence
  Description of Artificial Sequence: Synthetic peptide
  XENP018721 vhCDR3
YYGNYLGYFDV

SEQ ID NO: 8309 - protein, 11 aa, Artificial Sequence
  Description of Artificial Sequence: Synthetic peptide
  XENP018721 vlCDR1
RASQSVSNDVA

SEQ ID NO: 8310 - protein, 7 aa, Artificial Sequence
  Description of Artificial Sequence: Synthetic peptide
  XENP018721 vlCDR2
YASHRYT

SEQ ID NO: 8311 - protein, 9 aa, Artificial Sequence
  Description of Artificial Sequence: Synthetic peptide
  XENP018721 vlCDR3
QQDYSSPRT

SEQ ID NO: 8312 - protein, 249 aa, Artificial Sequence
  Description of Artificial Sequence: Synthetic polypeptide
  XENP018722 1G6_H1.218_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYFGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8313 - protein, 122 aa, Artificial Sequence
  Description of Artificial Sequence: Synthetic polypeptide
  VH of XENP018722
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYFGYFDVWGAGTLVTVSS

SEQ ID NO: 8314 - protein, 107 aa, Artificial Sequence; identical to SEQ ID NO: 6247
  Description of Artificial Sequence: Synthetic polypeptide
  VL of XENP018722

SEQ ID NO: 8315 - protein, 5 aa, Artificial Sequence
  Description of Artificial Sequence: Synthetic peptide
  XENP018722 vhCDR1
NYWMN

SEQ ID NO: 8316 - protein, 19 aa, Artificial Sequence
  Description of Artificial Sequence: Synthetic peptide
  XENP018722 vhCDR2
EIRLKSNNYATHYAEPVKG

SEQ ID NO: 8317 - protein, 11 aa, Artificial Sequence
  Description of Artificial Sequence: Synthetic peptide
  XENP018722 vhCDR3
YYGNYFGYFDV

SEQ ID NO: 8318 - protein, 11 aa, Artificial Sequence
  Description of Artificial Sequence: Synthetic peptide
  XENP018722 vlCDR1
RASQSVSNDVA

SEQ ID NO: 8319 - protein, 7 aa, Artificial Sequence
  Description of Artificial Sequence: Synthetic peptide
  XENP018722 vlCDR2
YASHRYT

SEQ ID NO: 8320 - protein, 9 aa, Artificial Sequence
  Description of Artificial Sequence: Synthetic peptide
  XENP018722 vlCDR3
QQDYSSPRT

SEQ ID NO: 8321 - protein, 249 aa, Artificial Sequence
  Description of Artificial Sequence: Synthetic polypeptide
  XENP018723 1G6_H1.219_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGAYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8322 - protein, 122 aa, Artificial Sequence
  Description of Artificial Sequence: Synthetic polypeptide
  VH of XENP018723
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGAYFDVWGAGTLVTVSS

SEQ ID NO: 8323 - protein, 107 aa, Artificial Sequence; identical to SEQ ID NO: 6247
  Description of Artificial Sequence: Synthetic polypeptide
  VL of XENP018723

SEQ ID NO: 8324 - protein, 5 aa, Artificial Sequence
  Description of Artificial Sequence: Synthetic peptide
  XENP018723 vhCDR1
NYWMN

SEQ ID NO: 8325 - protein, 19 aa, Artificial Sequence
  Description of Artificial Sequence: Synthetic peptide
  XENP018723 vhCDR2
EIRLKSNNYATHYAEPVKG

SEQ ID NO: 8326 - protein, 11 aa, Artificial Sequence
  Description of Artificial Sequence: Synthetic peptide
  XENP018723 vhCDR3
YYGNYGAYFDV

SEQ ID NO: 8327 - protein, 11 aa, Artificial Sequence
  Description of Artificial Sequence: Synthetic peptide
  XENP018723 vlCDR1
RASQSVSNDVA

SEQ ID NO: 8328 - protein, 7 aa, Artificial Sequence
  Description of Artificial Sequence: Synthetic peptide
  XENP018723 vlCDR2
YASHRYT

SEQ ID NO: 8329 - protein, 9 aa, Artificial Sequence
  Description of Artificial Sequence: Synthetic peptide
  XENP018723 vlCDR3
QQDYSSPRT

SEQ ID NO: 8330 - protein, 249 aa, Artificial Sequence
  Description of Artificial Sequence: Synthetic polypeptide
  XENP018724 1G6_H1.220_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGSYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8331 - protein, 122 aa, Artificial Sequence
  Description of Artificial Sequence: Synthetic polypeptide
  VH of XENP018724
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGSYFDVWGAGTLVTVSS

SEQ ID NO: 8332 - protein, 107 aa, Artificial Sequence; identical to SEQ ID NO: 6247
  Description of Artificial Sequence: Synthetic polypeptide
  VL of XENP018724

SEQ ID NO: 8333 - protein, 5 aa, Artificial Sequence
  Description of Artificial Sequence: Synthetic peptide
  XENP018724 vhCDR1
NYWMN

SEQ ID NO: 8334 - protein, 19 aa, Artificial Sequence
  Description of Artificial Sequence: Synthetic peptide
  XENP018724 vhCDR2
EIRLKSNNYATHYAEPVKG

SEQ ID NO: 8335 - protein, 11 aa, Artificial Sequence
  Description of Artificial Sequence: Synthetic peptide
  XENP018724 vhCDR3
YYGNYGSYFDV

SEQ ID NO: 8336 - protein, 11 aa, Artificial Sequence
  Description of Artificial Sequence: Synthetic peptide
  XENP018724 vlCDR1
RASQSVSNDVA

SEQ ID NO: 8337 - protein, 7 aa, Artificial Sequence
  Description of Artificial Sequence: Synthetic peptide
  XENP018724 vlCDR2
YASHRYT

SEQ ID NO: 8338 - protein, 9 aa, Artificial Sequence
  Description of Artificial Sequence: Synthetic peptide
  XENP018724 vlCDR3
QQDYSSPRT

SEQ ID NO: 8339 - protein, 249 aa, Artificial Sequence
  Description of Artificial Sequence: Synthetic polypeptide
  XENP018725 1G6_H1.221_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGTYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8340 - protein, 122 aa, Artificial Sequence
  Description of Artificial Sequence: Synthetic polypeptide
  VH of XENP018725
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGTYFDVWGAGTLVTVSS

SEQ ID NO: 8341 - protein, 107 aa, Artificial Sequence; identical to SEQ ID NO: 6247
  Description of Artificial Sequence: Synthetic polypeptide
  VL of XENP018725

SEQ ID NO: 8342 - protein, 5 aa, Artificial Sequence
  Description of Artificial Sequence: Synthetic peptide
  XENP018725 vhCDR1
NYWMN

SEQ ID NO: 8343 - protein, 19 aa, Artificial Sequence
  Description of Artificial Sequence: Synthetic peptide
  XENP018725 vhCDR2
EIRLKSNNYATHYAEPVKG

SEQ ID NO: 8344 - protein, 11 aa, Artificial Sequence
  Description of Artificial Sequence: Synthetic peptide
  XENP018725 vhCDR3
YYGNYGTYFDV

SEQ ID NO: 8345 - protein, 11 aa, Artificial Sequence
  Description of Artificial Sequence: Synthetic peptide
  XENP018725 vlCDR1
RASQSVSNDVA

SEQ ID NO: 8346 - protein, 7 aa, Artificial Sequence
  Description of Artificial Sequence: Synthetic peptide
  XENP018725 vlCDR2
YASHRYT

SEQ ID NO: 8347 - protein, 9 aa, Artificial Sequence
  Description of Artificial Sequence: Synthetic peptide
  XENP018725 vlCDR3
QQDYSSPRT

SEQ ID NO: 8348 - protein, 249 aa, Artificial Sequence
  Description of Artificial Sequence: Synthetic polypeptide
  XENP018726 1G6_H1.222_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGNYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8349 - protein, 122 aa, Artificial Sequence
  Description of Artificial Sequence: Synthetic polypeptide
  VH of XENP018726
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGNYFDVWGAGTLVTVSS

SEQ ID NO: 8350 - protein, 107 aa, Artificial Sequence; identical to SEQ ID NO: 6247
  Description of Artificial Sequence: Synthetic polypeptide
  VL of XENP018726

SEQ ID NO: 8351 - protein, 5 aa, Artificial Sequence
  Description of Artificial Sequence: Synthetic peptide
  XENP018726 vhCDR1
NYWMN

SEQ ID NO: 8352 - protein, 19 aa, Artificial Sequence
  Description of Artificial Sequence: Synthetic peptide
  XENP018726 vhCDR2
EIRLKSNNYATHYAEPVKG

SEQ ID NO: 8353 - protein, 11 aa, Artificial Sequence
  Description of Artificial Sequence: Synthetic peptide
  XENP018726 vhCDR3
YYGNYGNYFDV

SEQ ID NO: 8354 - protein, 11 aa, Artificial Sequence
  Description of Artificial Sequence: Synthetic peptide
  XENP018726 vlCDR1
RASQSVSNDVA

SEQ ID NO: 8355 - protein, 7 aa, Artificial Sequence
  Description of Artificial Sequence: Synthetic peptide
  XENP018726 vlCDR2
YASHRYT

SEQ ID NO: 8356 - protein, 9 aa, Artificial Sequence
  Description of Artificial Sequence: Synthetic peptide
  XENP018726 vlCDR3
QQDYSSPRT

SEQ ID NO: 8357 - protein, 249 aa, Artificial Sequence
  Description of Artificial Sequence: Synthetic polypeptide
  XENP018727 1G6_H1.223_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGHYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8358 - protein, 122 aa, Artificial Sequence
  Description of Artificial Sequence: Synthetic polypeptide
  VH of XENP018727
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGHYFDVWGAGTLVTVSS

SEQ ID NO: 8359 - protein, 107 aa, Artificial Sequence; identical to SEQ ID NO: 6247
  Description of Artificial Sequence: Synthetic polypeptide
  VL of XENP018727

SEQ ID NO: 8360 - protein, 5 aa, Artificial Sequence
  Description of Artificial Sequence: Synthetic peptide
  XENP018727 vhCDR1
NYWMN

SEQ ID NO: 8361 - protein, 19 aa, Artificial Sequence
  Description of Artificial Sequence: Synthetic peptide
  XENP018727 vhCDR2
EIRLKSNNYATHYAEPVKG

SEQ ID NO: 8362 - protein, 11 aa, Artificial Sequence
  Description of Artificial Sequence: Synthetic peptide
  XENP018727 vhCDR3
YYGNYGHYFDV

SEQ ID NO: 8363 - protein, 11 aa, Artificial Sequence
  Description of Artificial Sequence: Synthetic peptide
  XENP018727 vlCDR1
RASQSVSNDVA

SEQ ID NO: 8364 - protein, 7 aa, Artificial Sequence
  Description of Artificial Sequence: Synthetic peptide
  XENP018727 vlCDR2
YASHRYT

SEQ ID NO: 8365 - protein, 9 aa, Artificial Sequence
  Description of Artificial Sequence: Synthetic peptide
  XENP018727 vlCDR3
QQDYSSPRT

SEQ ID NO: 8366 - protein, 249 aa, Artificial Sequence
  Description of Artificial Sequence: Synthetic polypeptide
  XENP018728 1G6_H1.224_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGDYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8367 - protein, 122 aa, Artificial Sequence
  Description of Artificial Sequence: Synthetic polypeptide
  VH of XENP018728
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGDYFDVWGAGTLVTVSS

SEQ ID NO: 8368 - protein, 107 aa, Artificial Sequence; identical to SEQ ID NO: 6247
  Description of Artificial Sequence: Synthetic polypeptide
  VL of XENP018728

SEQ ID NO: 8369 - protein, 5 aa, Artificial Sequence
  Description of Artificial Sequence: Synthetic peptide
  XENP018728 vhCDR1
NYWMN

SEQ ID NO: 8370 - protein, 19 aa, Artificial Sequence
  Description of Artificial Sequence: Synthetic peptide
  XENP018728 vhCDR2
EIRLKSNNYATHYAEPVKG

SEQ ID NO: 8371 - protein, 11 aa, Artificial Sequence
  Description of Artificial Sequence: Synthetic peptide
  XENP018728 vhCDR3
YYGNYGDYFDV

SEQ ID NO: 8372 - protein, 11 aa, Artificial Sequence
  Description of Artificial Sequence: Synthetic peptide
  XENP018728 vlCDR1
RASQSVSNDVA

SEQ ID NO: 8373 - protein, 7 aa, Artificial Sequence
  Description of Artificial Sequence: Synthetic peptide
  XENP018728 vlCDR2
YASHRYT

SEQ ID NO: 8374 - protein, 9 aa, Artificial Sequence
  Description of Artificial Sequence: Synthetic peptide
  XENP018728 vlCDR3
QQDYSSPRT

SEQ ID NO: 8375 - protein, 249 aa, Artificial Sequence
  Description of Artificial Sequence: Synthetic polypeptide
  XENP018729 1G6_H1.225_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGKYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8376 - protein, 122 aa, Artificial Sequence
  Description of Artificial Sequence: Synthetic polypeptide
  VH of XENP018729
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGKYFDVWGAGTLVTVSS

SEQ ID NO: 8377 - protein, 107 aa, Artificial Sequence; identical to SEQ ID NO: 6247
  Description of Artificial Sequence: Synthetic polypeptide
  VL of XENP018729

SEQ ID NO: 8378 - protein, 5 aa, Artificial Sequence
  Description of Artificial Sequence: Synthetic peptide
  XENP018729 vhCDR1
NYWMN

SEQ ID NO: 8379 - protein, 19 aa, Artificial Sequence
  Description of Artificial Sequence: Synthetic peptide
  XENP018729 vhCDR2
EIRLKSNNYATHYAEPVKG

SEQ ID NO: 8380 - protein, 11 aa, Artificial Sequence
  Description of Artificial Sequence: Synthetic peptide
  XENP018729 vhCDR3
YYGNYGKYFDV

SEQ ID NO: 8381 - protein, 11 aa, Artificial Sequence
  Description of Artificial Sequence: Synthetic peptide
  XENP018729 vlCDR1
RASQSVSNDVA

SEQ ID NO: 8382 - protein, 7 aa, Artificial Sequence
  Description of Artificial Sequence: Synthetic peptide
  XENP018729 vlCDR2
YASHRYT

SEQ ID NO: 8383 - protein, 9 aa, Artificial Sequence
  Description of Artificial Sequence: Synthetic peptide
  XENP018729 vlCDR3
QQDYSSPRT

SEQ ID NO: 8384 - protein, 249 aa, Artificial Sequence
  Description of Artificial Sequence: Synthetic polypeptide
  XENP018730 1G6_H1.226_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGLYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8385 - protein, 122 aa, Artificial Sequence
  Description of Artificial Sequence: Synthetic polypeptide
  VH of XENP018730
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGLYFDVWGAGTLVTVSS

SEQ ID NO: 8386 - protein, 107 aa, Artificial Sequence; identical to SEQ ID NO: 6247
  Description of Artificial Sequence: Synthetic polypeptide
  VL of XENP018730

SEQ ID NO: 8387 - protein, 5 aa, Artificial Sequence
  Description of Artificial Sequence: Synthetic peptide
  XENP018730 vhCDR1
NYWMN

SEQ ID NO: 8388 - protein, 19 aa, Artificial Sequence
  Description of Artificial Sequence: Synthetic peptide
  XENP018730 vhCDR2
EIRLKSNNYATHYAEPVKG

SEQ ID NO: 8389 - protein, 11 aa, Artificial Sequence
  Description of Artificial Sequence: Synthetic peptide
  XENP018730 vhCDR3
YYGNYGLYFDV

SEQ ID NO: 8390 - protein, 11 aa, Artificial Sequence
  Description of Artificial Sequence: Synthetic peptide
  XENP018730 vlCDR1
RASQSVSNDVA

SEQ ID NO: 8391 - protein, 7 aa, Artificial Sequence
  Description of Artificial Sequence: Synthetic peptide
  XENP018730 vlCDR2
YASHRYT

SEQ ID NO: 8392 - protein, 9 aa, Artificial Sequence
  Description of Artificial Sequence: Synthetic peptide
  XENP018730 vlCDR3
QQDYSSPRT

SEQ ID NO: 8393 - protein, 249 aa, Artificial Sequence
  Description of Artificial Sequence: Synthetic polypeptide
  XENP018731 1G6_H1.227_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGFYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8394 - protein, 122 aa, Artificial Sequence
  Description of Artificial Sequence: Synthetic polypeptide
  VH of XENP018731
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGFYFDVWGAGTLVTVSS

SEQ ID NO: 8395 - protein, 107 aa, Artificial Sequence; identical to SEQ ID NO: 6247
  Description of Artificial Sequence: Synthetic polypeptide
  VL of XENP018731

SEQ ID NO: 8396 - protein, 5 aa, Artificial Sequence
  Description of Artificial Sequence: Synthetic peptide
  XENP018731 vhCDR1
NYWMN

SEQ ID NO: 8397 - protein, 19 aa, Artificial Sequence
  Description of Artificial Sequence: Synthetic peptide
  XENP018731 vhCDR2
EIRLKSNNYATHYAEPVKG

SEQ ID NO: 8398 - protein, 11 aa, Artificial Sequence
  Description of Artificial Sequence: Synthetic peptide
  XENP018731 vhCDR3
YYGNYGFYFDV

SEQ ID NO: 8399 - protein, 11 aa, Artificial Sequence
  Description of Artificial Sequence: Synthetic peptide
  XENP018731 vlCDR1
RASQSVSNDVA

SEQ ID NO: 8400 - protein, 7 aa, Artificial Sequence
  Description of Artificial Sequence: Synthetic peptide
  XENP018731 vlCDR2
YASHRYT

SEQ ID NO: 8401 - protein, 9 aa, Artificial Sequence
  Description of Artificial Sequence: Synthetic peptide
  XENP018731 vlCDR3
QQDYSSPRT

SEQ ID NO: 8402 - protein, 249 aa, Artificial Sequence
  Description of Artificial Sequence: Synthetic polypeptide
  XENP018732 1G6_H1.228_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGFFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8403 - protein, 122 aa, Artificial Sequence
  Description of Artificial Sequence: Synthetic polypeptide
  VH of XENP018732
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGFFDVWGAGTLVTVSS

SEQ ID NO: 8404 - protein, 107 aa, Artificial Sequence; identical to SEQ ID NO: 6247
  Description of Artificial Sequence: Synthetic polypeptide
  VL of XENP018732

SEQ ID NO: 8405 - protein, 5 aa, Artificial Sequence
  Description of Artificial Sequence: Synthetic peptide
  XENP018732 vhCDR1
NYWMN

SEQ ID NO: 8406 - protein, 19 aa, Artificial Sequence
  Description of Artificial Sequence: Synthetic peptide
  XENP018732 vhCDR2
EIRLKSNNYATHYAEPVKG

SEQ ID NO: 8407 - protein, 11 aa, Artificial Sequence
  Description of Artificial Sequence: Synthetic peptide
  XENP018732 vhCDR3
YYGNYGGFFDV

SEQ ID NO: 8408 - protein, 11 aa, Artificial Sequence
  Description of Artificial Sequence: Synthetic peptide
  XENP018732 vlCDR1
RASQSVSNDVA

SEQ ID NO: 8409 - protein, 7 aa, Artificial Sequence
  Description of Artificial Sequence: Synthetic peptide
  XENP018732 vlCDR2
YASHRYT

SEQ ID NO: 8410 - protein, 9 aa, Artificial Sequence
  Description of Artificial Sequence: Synthetic peptide
  XENP018732 vlCDR3
QQDYSSPRT

SEQ ID NO: 8411 - protein, 249 aa, Artificial Sequence
  Description of Artificial Sequence: Synthetic polypeptide
  XENP018733 1G6_H1.229_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGHFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8412 - protein, 122 aa, Artificial Sequence
  Description of Artificial Sequence: Synthetic polypeptide
  VH of XENP018733
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGHFDVWGAGTLVTVSS

SEQ ID NO: 8413 - protein, 107 aa, Artificial Sequence; identical to SEQ ID NO: 6247
  Description of Artificial Sequence: Synthetic polypeptide
  VL of XENP018733

SEQ ID NO: 8414 - protein, 5 aa, Artificial Sequence
  Description of Artificial Sequence: Synthetic peptide
  XENP018733 vhCDR1
NYWMN

SEQ ID NO: 8415 - protein, 19 aa, Artificial Sequence
  Description of Artificial Sequence: Synthetic peptide
  XENP018733 vhCDR2
EIRLKSNNYATHYAEPVKG

SEQ ID NO: 8416 - protein, 11 aa, Artificial Sequence
  Description of Artificial Sequence: Synthetic peptide
  XENP018733 vhCDR3
YYGNYGGHFDV

SEQ ID NO: 8417 - protein, 11 aa, Artificial Sequence
  Description of Artificial Sequence: Synthetic peptide
  XENP018733 vlCDR1
RASQSVSNDVA

SEQ ID NO: 8418 - protein, 7 aa, Artificial Sequence
  Description of Artificial Sequence: Synthetic peptide
  XENP018733 vlCDR2
YASHRYT

SEQ ID NO: 8419 - protein, 9 aa, Artificial Sequence
  Description of Artificial Sequence: Synthetic peptide
  XENP018733 vlCDR3
QQDYSSPRT

SEQ ID NO: 8420 - protein, 249 aa, Artificial Sequence
  Description of Artificial Sequence: Synthetic polypeptide
  XENP018734 1G6_H1.230_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGLFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8421 - protein, 122 aa, Artificial Sequence
  Description of Artificial Sequence: Synthetic polypeptide
  VH of XENP018734
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGLFDVWGAGTLVTVSS

SEQ ID NO: 8422 - protein, 107 aa, Artificial Sequence; identical to SEQ ID NO: 6247
  Description of Artificial Sequence: Synthetic polypeptide
  VL of XENP018734

SEQ ID NO: 8423 - protein, 5 aa, Artificial Sequence
  Description of Artificial Sequence: Synthetic peptide
  XENP018734 vhCDR1
NYWMN

SEQ ID NO: 8424 - protein, 19 aa, Artificial Sequence
  Description of Artificial Sequence: Synthetic peptide
  XENP018734 vhCDR2
EIRLKSNNYATHYAEPVKG

SEQ ID NO: 8425 - protein, 11 aa, Artificial Sequence
  Description of Artificial Sequence: Synthetic peptide
  XENP018734 vhCDR3
YYGNYGGLFDV

SEQ ID NO: 8426 - protein, 11 aa, Artificial Sequence
  Description of Artificial Sequence: Synthetic peptide
  XENP018734 vlCDR1
RASQSVSNDVA

SEQ ID NO: 8427 - protein, 7 aa, Artificial Sequence
  Description of Artificial Sequence: Synthetic peptide
  XENP018734 vlCDR2
YASHRYT

SEQ ID NO: 8428 - protein, 9 aa, Artificial Sequence
  Description of Artificial Sequence: Synthetic peptide
  XENP018734 vlCDR3
QQDYSSPRT

SEQ ID NO: 8429 - protein, 249 aa, Artificial Sequence
  Description of Artificial Sequence: Synthetic polypeptide
  XENP018735 1G6_H1.231_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGWFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8430 - protein, 122 aa, Artificial Sequence
  Description of Artificial Sequence: Synthetic polypeptide
  VH of XENP018735
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGWFDVWGAGTLVTVSS

SEQ ID NO: 8431 - protein, 107 aa, Artificial Sequence; identical to SEQ ID NO: 6247
  Description of Artificial Sequence: Synthetic polypeptide
  VL of XENP018735

SEQ ID NO: 8432 - protein, 5 aa, Artificial Sequence
  Description of Artificial Sequence: Synthetic peptide
  XENP018735 vhCDR1
NYWMN

SEQ ID NO: 8433 - protein, 19 aa, Artificial Sequence
  Description of Artificial Sequence: Synthetic peptide
  XENP018735 vhCDR2
EIRLKSNNYATHYAEPVKG

SEQ ID NO: 8434 - protein, 11 aa, Artificial Sequence
  Description of Artificial Sequence: Synthetic peptide
  XENP018735 vhCDR3
YYGNYGGWFDV

SEQ ID NO: 8435 - protein, 11 aa, Artificial Sequence
  Description of Artificial Sequence: Synthetic peptide
  XENP018735 vlCDR1
RASQSVSNDVA

SEQ ID NO: 8436 - protein, 7 aa, Artificial Sequence
  Description of Artificial Sequence: Synthetic peptide
  XENP018735 vlCDR2
YASHRYT

SEQ ID NO: 8437 - protein, 9 aa, Artificial Sequence
  Description of Artificial Sequence: Synthetic peptide
  XENP018735 vlCDR3
QQDYSSPRT

SEQ ID NO: 8438 - protein, 249 aa, Artificial Sequence
  Description of Artificial Sequence: Synthetic polypeptide
  XENP018736 1G6_H1.232_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGVFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8439 - protein, 122 aa, Artificial Sequence
  Description of Artificial Sequence: Synthetic polypeptide
  VH of XENP018736
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGVFDVWGAGTLVTVSS

SEQ ID NO: 8440 - protein, 107 aa, Artificial Sequence; identical to SEQ ID NO: 6247
  Description of Artificial Sequence: Synthetic polypeptide
  VL of XENP018736

SEQ ID NO: 8441 - protein, 5 aa, Artificial Sequence
  Description of Artificial Sequence: Synthetic peptide
  XENP018736 vhCDR1
NYWMN

SEQ ID NO: 8442 - protein, 19 aa, Artificial Sequence
  Description of Artificial Sequence: Synthetic peptide
  XENP018736 vhCDR2
EIRLKSNNYATHYAEPVKG

SEQ ID NO: 8443 - protein, 11 aa, Artificial Sequence
  Description of Artificial Sequence: Synthetic peptide
  XENP018736 vhCDR3
YYGNYGGVFDV

SEQ ID NO: 8444 - protein, 11 aa, Artificial Sequence
  Description of Artificial Sequence: Synthetic peptide
  XENP018736 vlCDR1
RASQSVSNDVA

SEQ ID NO: 8445 - protein, 7 aa, Artificial Sequence
  Description of Artificial Sequence: Synthetic peptide
  XENP018736 vlCDR2
YASHRYT

SEQ ID NO: 8446 - protein, 9 aa, Artificial Sequence
  Description of Artificial Sequence: Synthetic peptide
  XENP018736 vlCDR3
QQDYSSPRT

SEQ ID NO: 8447 - protein, 249 aa, Artificial Sequence
  Description of Artificial Sequence: Synthetic polypeptide
  XENP018737 1G6_H1.233_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGAFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8448 - protein, 122 aa, Artificial Sequence
  Description of Artificial Sequence: Synthetic polypeptide
  VH of XENP018737
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGAFDVWGAGTLVTVSS

SEQ ID NO: 8449 - protein, 107 aa, Artificial Sequence; identical to SEQ ID NO: 6247
  Description of Artificial Sequence: Synthetic polypeptide
  VL of XENP018737

SEQ ID NO: 8450 - protein, 5 aa, Artificial Sequence
  Description of Artificial Sequence: Synthetic peptide
  XENP018737 vhCDR1
NYWMN

SEQ ID NO: 8451 - protein, 19 aa, Artificial Sequence
  Description of Artificial Sequence: Synthetic peptide
  XENP018737 vhCDR2
EIRLKSNNYATHYAEPVKG

SEQ ID NO: 8452 - protein, 11 aa, Artificial Sequence
  Description of Artificial Sequence: Synthetic peptide
  XENP018737 vhCDR3
YYGNYGGAFDV

SEQ ID NO: 8453 - protein, 11 aa, Artificial Sequence
  Description of Artificial Sequence: Synthetic peptide
  XENP018737 vlCDR1
RASQSVSNDVA

SEQ ID NO: 8454 - protein, 7 aa, Artificial Sequence
  Description of Artificial Sequence: Synthetic peptide
  XENP018737 vlCDR2
YASHRYT

SEQ ID NO: 8455 - protein, 9 aa, Artificial Sequence
  Description of Artificial Sequence: Synthetic peptide
  XENP018737 vlCDR3
QQDYSSPRT

SEQ ID NO: 8456 - protein, 249 aa, Artificial Sequence
  Description of Artificial Sequence: Synthetic polypeptide
  XENP018738 1G6_H1.234_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGQFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8457 - protein, 122 aa, Artificial Sequence
  Description of Artificial Sequence: Synthetic polypeptide
  VH of XENP018738
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGQFDVWGAGTLVTVSS

SEQ ID NO: 8458 - protein, 107 aa, Artificial Sequence; identical to SEQ ID NO: 6247
  Description of Artificial Sequence: Synthetic polypeptide
  VL of XENP018738

SEQ ID NO: 8459 - protein, 5 aa, Artificial Sequence
  Description of Artificial Sequence: Synthetic peptide
  XENP018738 vhCDR1
NYWMN

SEQ ID NO: 8460 - protein, 19 aa, Artificial Sequence
  Description of Artificial Sequence: Synthetic peptide
  XENP018738 vhCDR2
EIRLKSNNYATHYAEPVKG

SEQ ID NO: 8461 - protein, 11 aa, Artificial Sequence
  Description of Artificial Sequence: Synthetic peptide
  XENP018738 vhCDR3
YYGNYGGQFDV

SEQ ID NO: 8462 - protein, 11 aa, Artificial Sequence
  Description of Artificial Sequence: Synthetic peptide
  XENP018738 vlCDR1
RASQSVSNDVA

SEQ ID NO: 8463 - protein, 7 aa, Artificial Sequence
  Description of Artificial Sequence: Synthetic peptide
  XENP018738 vlCDR2
YASHRYT

SEQ ID NO: 8464 - protein, 9 aa, Artificial Sequence
  Description of Artificial Sequence: Synthetic peptide
  XENP018738 vlCDR3
QQDYSSPRT

SEQ ID NO: 8465 - protein, 249 aa, Artificial Sequence
  Description of Artificial Sequence: Synthetic polypeptide
  XENP018739 1G6_H1.235_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGDFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8466 - protein, 122 aa, Artificial Sequence
  Description of Artificial Sequence: Synthetic polypeptide
  VH of XENP018739
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGDFDVWGAGTLVTVSS

SEQ ID NO: 8467 - protein, 107 aa, Artificial Sequence; identical to SEQ ID NO: 6247
  Description of Artificial Sequence: Synthetic polypeptide
  VL of XENP018739

SEQ ID NO: 8468 - protein, 5 aa, Artificial Sequence
  Description of Artificial Sequence: Synthetic peptide
  XENP018739 vhCDR1
NYWMN

SEQ ID NO: 8469 - protein, 19 aa, Artificial Sequence
  Description of Artificial Sequence: Synthetic peptide
  XENP018739 vhCDR2
EIRLKSNNYATHYAEPVKG

SEQ ID NO: 8470 - protein, 11 aa, Artificial Sequence
  Description of Artificial Sequence: Synthetic peptide
  XENP018739 vhCDR3
YYGNYGGDFDV

SEQ ID NO: 8471 - protein, 11 aa, Artificial Sequence
  Description of Artificial Sequence: Synthetic peptide
  XENP018739 vlCDR1
RASQSVSNDVA

SEQ ID NO: 8472 - protein, 7 aa, Artificial Sequence
  Description of Artificial Sequence: Synthetic peptide
  XENP018739 vlCDR2
YASHRYT

SEQ ID NO: 8473 - protein, 9 aa, Artificial Sequence
  Description of Artificial Sequence: Synthetic peptide
  XENP018739 vlCDR3
QQDYSSPRT

SEQ ID NO: 8474 - protein, 249 aa, Artificial Sequence
  Description of Artificial Sequence: Synthetic polypeptide
  XENP018740 1G6_H1.236_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGKFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8475 - protein, 122 aa, Artificial Sequence
  Description of Artificial Sequence: Synthetic polypeptide
  VH of XENP018740
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGKFDVWGAGTLVTVSS

SEQ ID NO: 8476 - protein, 107 aa, Artificial Sequence; identical to SEQ ID NO: 6247
  Description of Artificial Sequence: Synthetic polypeptide
  VL of XENP018740

SEQ ID NO: 8477 - protein, 5 aa, Artificial Sequence
  Description of Artificial Sequence: Synthetic peptide
  XENP018740 vhCDR1
NYWMN

SEQ ID NO: 8478 - protein, 19 aa, Artificial Sequence
  Description of Artificial Sequence: Synthetic peptide
  XENP018740 vhCDR2
EIRLKSNNYATHYAEPVKG

SEQ ID NO: 8479 - protein, 11 aa, Artificial Sequence
  Description of Artificial Sequence: Synthetic peptide
  XENP018740 vhCDR3
YYGNYGGKFDV

SEQ ID NO: 8480 - protein, 11 aa, Artificial Sequence
  Description of Artificial Sequence: Synthetic peptide
  XENP018740 vlCDR1
RASQSVSNDVA

SEQ ID NO: 8481 - protein, 7 aa, Artificial Sequence
  Description of Artificial Sequence: Synthetic peptide
  XENP018740 vlCDR2
YASHRYT

SEQ ID NO: 8482 - protein, 9 aa, Artificial Sequence
  Description of Artificial Sequence: Synthetic peptide
  XENP018740 vlCDR3
QQDYSSPRT

SEQ ID NO: 8483 - protein, 249 aa, Artificial Sequence
  Description of Artificial Sequence: Synthetic polypeptide
  XENP018741 1G6_H1.237_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDYWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8484 - protein, 122 aa, Artificial Sequence
  Description of Artificial Sequence: Synthetic polypeptide
  VH of XENP018741
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDYWGAGTLVTVSS

SEQ ID NO: 8485 - protein, 107 aa, Artificial Sequence; identical to SEQ ID NO: 6247
  Description of Artificial Sequence: Synthetic polypeptide
  VL of XENP018741

SEQ ID NO: 8486 - protein, 5 aa, Artificial Sequence
  Description of Artificial Sequence: Synthetic peptide
  XENP018741 vhCDR1
NYWMN

SEQ ID NO: 8487 - protein, 19 aa, Artificial Sequence
  Description of Artificial Sequence: Synthetic peptide
  XENP018741 vhCDR2
EIRLKSNNYATHYAEPVKG

SEQ ID NO: 8488 - protein, 11 aa, Artificial Sequence
  Description of Artificial Sequence: Synthetic peptide
  XENP018741 vhCDR3
YYGNYGGYFDY

SEQ ID NO: 8489 - protein, 11 aa, Artificial Sequence
  Description of Artificial Sequence: Synthetic peptide
  XENP018741 vlCDR1
RASQSVSNDVA

SEQ ID NO: 8490 - protein, 7 aa, Artificial Sequence
  Description of Artificial Sequence: Synthetic peptide
  XENP018741 vlCDR2
YASHRYT

SEQ ID NO: 8491 - protein, 9 aa, Artificial Sequence
  Description of Artificial Sequence: Synthetic peptide
  XENP018741 vlCDR3
QQDYSSPRT

SEQ ID NO: 8492 - protein, 249 aa, Artificial Sequence
  Description of Artificial Sequence: Synthetic polypeptide
  XENP018742 1G6_H1.238_L1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGQGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8493 - protein, 122 aa, Artificial Sequence
  Description of Artificial Sequence: Synthetic polypeptide
  VH of XENP018742
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGQGTLVTVSS

SEQ ID NO: 8494 - protein, 107 aa, Artificial Sequence; identical to SEQ ID NO: 6247
  Description of Artificial Sequence: Synthetic polypeptide
  VL of XENP018742

SEQ ID NO: 8495 - protein, 5 aa, Artificial Sequence
  Description of Artificial Sequence: Synthetic peptide
  XENP018742 vhCDR1
NYWMN

SEQ ID NO: 8496 - protein, 19 aa, Artificial Sequence
  Description of Artificial Sequence: Synthetic peptide
  XENP018742 vhCDR2
EIRLKSNNYATHYAEPVKG

SEQ ID NO: 8497 - protein, 11 aa, Artificial Sequence
  Description of Artificial Sequence: Synthetic peptide
  XENP018742 vhCDR3
YYGNYGGYFDV

SEQ ID NO: 8498 - protein, 11 aa, Artificial Sequence
  Description of Artificial Sequence: Synthetic peptide
  XENP018742 vlCDR1
RASQSVSNDVA

SEQ ID NO: 8499 - protein, 7 aa, Artificial Sequence
  Description of Artificial Sequence: Synthetic peptide
  XENP018742 vlCDR2
YASHRYT

SEQ ID NO: 8500 - protein, 9 aa, Artificial Sequence
  Description of Artificial Sequence: Synthetic peptide
  XENP018742 vlCDR3
QQDYSSPRT

SEQ ID NO: 8501 - protein, 249 aa, Artificial Sequence
  Description of Artificial Sequence: Synthetic polypeptide
  XENP018743 1G6_H1_L1.1_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSEIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8502 - protein, 122 aa, Artificial Sequence; identical to SEQ ID NO: 6246
  Description of Artificial Sequence: Synthetic polypeptide
  VH of XENP018743

SEQ ID NO: 8503 - protein, 107 aa, Artificial Sequence
  Description of Artificial Sequence: Synthetic polypeptide
  VL of XENP018743
EIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8504 - protein, 5 aa, Artificial Sequence
  Description of Artificial Sequence: Synthetic peptide
  XENP018743 vhCDR1
NYWMN

SEQ ID NO: 8505 - protein, 19 aa, Artificial Sequence
  Description of Artificial Sequence: Synthetic peptide
  XENP018743 vhCDR2
EIRLKSNNYATHYAEPVKG

SEQ ID NO: 8506 - protein, 11 aa, Artificial Sequence
  Description of Artificial Sequence: Synthetic peptide
  XENP018743 vhCDR3
YYGNYGGYFDV

SEQ ID NO: 8507 - protein, 11 aa, Artificial Sequence
  Description of Artificial Sequence: Synthetic peptide
  XENP018743 vlCDR1
RASQSVSNDVA

SEQ ID NO: 8508 - protein, 7 aa, Artificial Sequence
  Description of Artificial Sequence: Synthetic peptide
  XENP018743 vlCDR2
YASHRYT

SEQ ID NO: 8509 - protein, 9 aa, Artificial Sequence
  Description of Artificial Sequence: Synthetic peptide
  XENP018743 vlCDR3
QQDYSSPRT

SEQ ID NO: 8510 - protein, 249 aa, Artificial Sequence
  Description of Artificial Sequence: Synthetic polypeptide
  XENP018744 1G6_H1_L1.2_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSDIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8511 - protein, 122 aa, Artificial Sequence; identical to SEQ ID NO: 6246
  Description of Artificial Sequence: Synthetic polypeptide
  VH of XENP018744

SEQ ID NO: 8512 - protein, 107 aa, Artificial Sequence
  Description of Artificial Sequence: Synthetic polypeptide
  VL of XENP018744
DIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8513 - protein, 5 aa, Artificial Sequence
  Description of Artificial Sequence: Synthetic peptide
  XENP018744 vhCDR1
NYWMN

SEQ ID NO: 8514 - protein, 19 aa, Artificial Sequence
  Description of Artificial Sequence: Synthetic peptide
  XENP018744 vhCDR2
EIRLKSNNYATHYAEPVKG

SEQ ID NO: 8515 - protein, 11 aa, Artificial Sequence
  Description of Artificial Sequence: Synthetic peptide
  XENP018744 vhCDR3
YYGNYGGYFDV

SEQ ID NO: 8516 - protein, 11 aa, Artificial Sequence
  Description of Artificial Sequence: Synthetic peptide
  XENP018744 vlCDR1
RASQSVSNDVA

SEQ ID NO: 8517 - protein, 7 aa, Artificial Sequence
  Description of Artificial Sequence: Synthetic peptide
  XENP018744 vlCDR2
YASHRYT

SEQ ID NO: 8518 - protein, 9 aa, Artificial Sequence
  Description of Artificial Sequence: Synthetic peptide
  XENP018744 vlCDR3
QQDYSSPRT

SEQ ID NO: 8519 - protein, 249 aa, Artificial Sequence
  Description of Artificial Sequence: Synthetic polypeptide
  XENP018745 1G6_H1_L1.3_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSVVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8520 - protein, 122 aa, Artificial Sequence; identical to SEQ ID NO: 6246
  Description of Artificial Sequence: Synthetic polypeptide
  VH of XENP018745

SEQ ID NO: 8521 - protein, 107 aa, Artificial Sequence
  Description of Artificial Sequence: Synthetic polypeptide
  VL of XENP018745
SVVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8522 - protein, 5 aa, Artificial Sequence
  Description of Artificial Sequence: Synthetic peptide
  XENP018745 vhCDR1
NYWMN

SEQ ID NO: 8523 - protein, 19 aa, Artificial Sequence
  Description of Artificial Sequence: Synthetic peptide
  XENP018745 vhCDR2
EIRLKSNNYATHYAEPVKG

SEQ ID NO: 8524 - protein, 11 aa, Artificial Sequence
  Description of Artificial Sequence: Synthetic peptide
  XENP018745 vhCDR3
YYGNYGGYFDV

SEQ ID NO: 8525 - protein, 11 aa, Artificial Sequence
  Description of Artificial Sequence: Synthetic peptide
  XENP018745 vlCDR1
RASQSVSNDVA

SEQ ID NO: 8526 - protein, 7 aa, Artificial Sequence
  Description of Artificial Sequence: Synthetic peptide
  XENP018745 vlCDR2
YASHRYT

SEQ ID NO: 8527 - protein, 9 aa, Artificial Sequence
  Description of Artificial Sequence: Synthetic peptide
  XENP018745 vlCDR3
QQDYSSPRT

SEQ ID NO: 8528 - protein, 249 aa, Artificial Sequence
  Description of Artificial Sequence: Synthetic polypeptide
  XENP018746 1G6_H1_L1.4_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVLTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8529 - protein, 122 aa, Artificial Sequence; identical to SEQ ID NO: 6246
  Description of Artificial Sequence: Synthetic polypeptide
  VH of XENP018746

SEQ ID NO: 8530 - protein, 107 aa, Artificial Sequence
  Description of Artificial Sequence: Synthetic polypeptide
  VL of XENP018746
SIVLTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8531 - protein, 5 aa, Artificial Sequence
  Description of Artificial Sequence: Synthetic peptide
  XENP018746 vhCDR1
NYWMN

SEQ ID NO: 8532 - protein, 19 aa, Artificial Sequence
  Description of Artificial Sequence: Synthetic peptide
  XENP018746 vhCDR2
EIRLKSNNYATHYAEPVKG

SEQ ID NO: 8533 - protein, 11 aa, Artificial Sequence
  Description of Artificial Sequence: Synthetic peptide
  XENP018746 vhCDR3
YYGNYGGYFDV

SEQ ID NO: 8534 - protein, 11 aa, Artificial Sequence
  Description of Artificial Sequence: Synthetic peptide
  XENP018746 vlCDR1
RASQSVSNDVA

SEQ ID NO: 8535 - protein, 7 aa, Artificial Sequence
  Description of Artificial Sequence: Synthetic peptide
  XENP018746 vlCDR2
YASHRYT

SEQ ID NO: 8536 - protein, 9 aa, Artificial Sequence
  Description of Artificial Sequence: Synthetic peptide
  XENP018746 vlCDR3
QQDYSSPRT

SEQ ID NO: 8537 - protein, 249 aa, Artificial Sequence
  Description of Artificial Sequence: Synthetic polypeptide
  XENP018747 1G6_H1_L1.5_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQTPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8538 - protein, 122 aa, Artificial Sequence; identical to SEQ ID NO: 6246
  Description of Artificial Sequence: Synthetic polypeptide
  VH of XENP018747

SEQ ID NO: 8539 - protein, 107 aa, Artificial Sequence
  Description of Artificial Sequence: Synthetic polypeptide
  VL of XENP018747
SIVMTQTPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8540 - protein, 5 aa, Artificial Sequence
  Description of Artificial Sequence: Synthetic peptide
  XENP018747 vhCDR1
NYWMN

SEQ ID NO: 8541 - protein, 19 aa, Artificial Sequence
  Description of Artificial Sequence: Synthetic peptide
  XENP018747 vhCDR2
EIRLKSNNYATHYAEPVKG

SEQ ID NO: 8542 - protein, 11 aa, Artificial Sequence
  Description of Artificial Sequence: Synthetic peptide
  XENP018747 vhCDR3
YYGNYGGYFDV

SEQ ID NO: 8543 - protein, 11 aa, Artificial Sequence
  Description of Artificial Sequence: Synthetic peptide
  XENP018747 vlCDR1
RASQSVSNDVA

SEQ ID NO: 8544 - protein, 7 aa, Artificial Sequence
  Description of Artificial Sequence: Synthetic peptide
  XENP018747 vlCDR2
YASHRYT

SEQ ID NO: 8545 - protein, 9 aa, Artificial Sequence
  Description of Artificial Sequence: Synthetic peptide
  XENP018747 vlCDR3
QQDYSSPRT

SEQ ID NO: 8546 - protein, 249 aa, Artificial Sequence
  Description of Artificial Sequence: Synthetic polypeptide
  XENP018748 1G6_H1_L1.6_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPKTLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8547 - protein, 122 aa, Artificial Sequence; identical to SEQ ID NO: 6246
  Description of Artificial Sequence: Synthetic polypeptide
  VH of XENP018748

SEQ ID NO: 8548 - protein, 107 aa, Artificial Sequence
  Description of Artificial Sequence: Synthetic polypeptide
  VL of XENP018748
SIVMTQSPKTLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8549 - protein, 5 aa, Artificial Sequence
  Description of Artificial Sequence: Synthetic peptide
  XENP018748 vhCDR1
NYWMN

SEQ ID NO: 8550 - protein, 19 aa, Artificial Sequence
  Description of Artificial Sequence: Synthetic peptide
  XENP018748 vhCDR2
EIRLKSNNYATHYAEPVKG

SEQ ID NO: 8551 - protein, 11 aa, Artificial Sequence
  Description of Artificial Sequence: Synthetic peptide
  XENP018748 vhCDR3
YYGNYGGYFDV

SEQ ID NO: 8552 - protein, 11 aa, Artificial Sequence
  Description of Artificial Sequence: Synthetic peptide
  XENP018748 vlCDR1
RASQSVSNDVA

SEQ ID NO: 8553 - protein, 7 aa, Artificial Sequence
  Description of Artificial Sequence: Synthetic peptide
  XENP018748 vlCDR2
YASHRYT

SEQ ID NO: 8554 - protein, 9 aa, Artificial Sequence
  Description of Artificial Sequence: Synthetic peptide
  XENP018748 vlCDR3
QQDYSSPRT

SEQ ID NO: 8555 - protein, 249 aa, Artificial Sequence
  Description of Artificial Sequence: Synthetic polypeptide
  XENP018749 1G6_H1_L1.7_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPASLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8556 - protein, 122 aa, Artificial Sequence; identical to SEQ ID NO: 6246
  Description of Artificial Sequence: Synthetic polypeptide
  VH of XENP018749

SEQ ID NO: 8557 - protein, 107 aa, Artificial Sequence
  Description of Artificial Sequence: Synthetic polypeptide
  VL of XENP018749
SIVMTQSPASLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8558 - protein, 5 aa, Artificial Sequence
  Description of Artificial Sequence: Synthetic peptide
  XENP018749 vhCDR1
NYWMN

SEQ ID NO: 8559 - protein, 19 aa, Artificial Sequence
  Description of Artificial Sequence: Synthetic peptide
  XENP018749 vhCDR2
EIRLKSNNYATHYAEPVKG

SEQ ID NO: 8560 - protein, 11 aa, Artificial Sequence
  Description of Artificial Sequence: Synthetic peptide
  XENP018749 vhCDR3
YYGNYGGYFDV

SEQ ID NO: 8561 - protein, 11 aa, Artificial Sequence
  Description of Artificial Sequence: Synthetic peptide
  XENP018749 vlCDR1
RASQSVSNDVA

SEQ ID NO: 8562 - protein, 7 aa, Artificial Sequence
  Description of Artificial Sequence: Synthetic peptide
  XENP018749 vlCDR2
YASHRYT

SEQ ID NO: 8563 - protein, 9 aa, Artificial Sequence
  Description of Artificial Sequence: Synthetic peptide
  XENP018749 vlCDR3
QQDYSSPRT

SEQ ID NO: 8564 - protein, 249 aa, Artificial Sequence
  Description of Artificial Sequence: Synthetic polypeptide
  XENP018750 1G6_H1_L1.8_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPAFLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8565 - protein, 122 aa, Artificial Sequence; identical to SEQ ID NO: 6246
  Description of Artificial Sequence: Synthetic polypeptide
  VH of XENP018750

SEQ ID NO: 8566 - protein, 107 aa, Artificial Sequence
  Description of Artificial Sequence: Synthetic polypeptide
  VL of XENP018750
SIVMTQSPAFLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8567 - protein, 5 aa, Artificial Sequence
  Description of Artificial Sequence: Synthetic peptide
  XENP018750 vhCDR1
NYWMN

SEQ ID NO: 8568 - protein, 19 aa, Artificial Sequence
  Description of Artificial Sequence: Synthetic peptide
  XENP018750 vhCDR2
EIRLKSNNYATHYAEPVKG

SEQ ID NO: 8569 - protein, 11 aa, Artificial Sequence
  Description of Artificial Sequence: Synthetic peptide
  XENP018750 vhCDR3
YYGNYGGYFDV

SEQ ID NO: 8570 - protein, 11 aa, Artificial Sequence
  Description of Artificial Sequence: Synthetic peptide
  XENP018750 vlCDR1
RASQSVSNDVA

SEQ ID NO: 8571 - protein, 7 aa, Artificial Sequence
  Description of Artificial Sequence: Synthetic peptide
  XENP018750 vlCDR2
YASHRYT

SEQ ID NO: 8572 - protein, 9 aa, Artificial Sequence
  Description of Artificial Sequence: Synthetic peptide
  XENP018750 vlCDR3
QQDYSSPRT

SEQ ID NO: 8573 - protein, 249 aa, Artificial Sequence
  Description of Artificial Sequence: Synthetic polypeptide
  XENP018751 1G6_H1_L1.9_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLLVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8574 - protein, 122 aa, Artificial Sequence; identical to SEQ ID NO: 6246
  Description of Artificial Sequence: Synthetic polypeptide
  VH of XENP018751

SEQ ID NO: 8575 - protein, 107 aa, Artificial Sequence
  Description of Artificial Sequence: Synthetic polypeptide
  VL of XENP018751
SIVMTQSPATLLVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8576 - protein, 5 aa, Artificial Sequence
  Description of Artificial Sequence: Synthetic peptide
  XENP018751 vhCDR1
NYWMN

SEQ ID NO: 8577 - protein, 19 aa, Artificial Sequence
  Description of Artificial Sequence: Synthetic peptide
  XENP018751 vhCDR2
EIRLKSNNYATHYAEPVKG

SEQ ID NO: 8578 - protein, 11 aa, Artificial Sequence
  Description of Artificial Sequence: Synthetic peptide
  XENP018751 vhCDR3
YYGNYGGYFDV

SEQ ID NO: 8579 - protein, 11 aa, Artificial Sequence
  Description of Artificial Sequence: Synthetic peptide
  XENP018751 vlCDR1
RASQSVSNDVA

SEQ ID NO: 8580 - protein, 7 aa, Artificial Sequence
  Description of Artificial Sequence: Synthetic peptide
  XENP018751 vlCDR2
YASHRYT

SEQ ID NO: 8581 - protein, 9 aa, Artificial Sequence
  Description of Artificial Sequence: Synthetic peptide
  XENP018751 vlCDR3
QQDYSSPRT

SEQ ID NO: 8582 - protein, 249 aa, Artificial Sequence
  Description of Artificial Sequence: Synthetic polypeptide
  XENP018752 1G6_H1_L1.10_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSAGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8583 - protein, 122 aa, Artificial Sequence; identical to SEQ ID NO: 6246
  Description of Artificial Sequence: Synthetic polypeptide
  VH of XENP018752

SEQ ID NO: 8584 - protein, 107 aa, Artificial Sequence
  Description of Artificial Sequence: Synthetic polypeptide
  VL of XENP018752
SIVMTQSPATLSVSAGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8585 - protein, 5 aa, Artificial Sequence
  Description of Artificial Sequence: Synthetic peptide
  XENP018752 vhCDR1
NYWMN

SEQ ID NO: 8586 - protein, 19 aa, Artificial Sequence
  Description of Artificial Sequence: Synthetic peptide
  XENP018752 vhCDR2
EIRLKSNNYATHYAEPVKG

SEQ ID NO: 8587 - protein, 11 aa, Artificial Sequence
  Description of Artificial Sequence: Synthetic peptide
  XENP018752 vhCDR3
YYGNYGGYFDV

SEQ ID NO: 8588 - protein, 11 aa, Artificial Sequence
  Description of Artificial Sequence: Synthetic peptide
  XENP018752 vlCDR1
RASQSVSNDVA

SEQ ID NO: 8589 - protein, 7 aa, Artificial Sequence
  Description of Artificial Sequence: Synthetic peptide
  XENP018752 vlCDR2
YASHRYT

SEQ ID NO: 8590 - protein, 9 aa, Artificial Sequence
  Description of Artificial Sequence: Synthetic peptide
  XENP018752 vlCDR3
QQDYSSPRT

SEQ ID NO: 8591 - protein, 249 aa, Artificial Sequence
  Description of Artificial Sequence: Synthetic polypeptide
  XENP018753 1G6_H1_L1.11_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGDRATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8592 - protein, 122 aa, Artificial Sequence; identical to SEQ ID NO: 6246
  Description of Artificial Sequence: Synthetic polypeptide
  VH of XENP018753

SEQ ID NO: 8593 - protein, 107 aa, Artificial Sequence
  Description of Artificial Sequence: Synthetic polypeptide
  VL of XENP018753
SIVMTQSPATLSVSPGDRATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8594 - protein, 5 aa, Artificial Sequence
  Description of Artificial Sequence: Synthetic peptide
  XENP018753 vhCDR1
NYWMN

SEQ ID NO: 8595 - protein, 19 aa, Artificial Sequence
  Description of Artificial Sequence: Synthetic peptide
  XENP018753 vhCDR2
EIRLKSNNYATHYAEPVKG

SEQ ID NO: 8596 - protein, 11 aa, Artificial Sequence
  Description of Artificial Sequence: Synthetic peptide
  XENP018753 vhCDR3
YYGNYGGYFDV

SEQ ID NO: 8597 - protein, 11 aa, Artificial Sequence
  Description of Artificial Sequence: Synthetic peptide
  XENP018753 vlCDR1
RASQSVSNDVA

SEQ ID NO: 8598 - protein, 7 aa, Artificial Sequence
  Description of Artificial Sequence: Synthetic peptide
  XENP018753 vlCDR2
YASHRYT

SEQ ID NO: 8599 - protein, 9 aa, Artificial Sequence
  Description of Artificial Sequence: Synthetic peptide
  XENP018753 vlCDR3
QQDYSSPRT

SEQ ID NO: 8600 - protein, 249 aa, Artificial Sequence
  Description of Artificial Sequence: Synthetic polypeptide
  XENP018754 1G6_H1_L1.12_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERVTLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8601 - protein, 122 aa, Artificial Sequence; identical to SEQ ID NO: 6246
  Description of Artificial Sequence: Synthetic polypeptide
  VH of XENP018754

SEQ ID NO: 8602 - protein, 107 aa, Artificial Sequence
  Description of Artificial Sequence: Synthetic polypeptide
  VL of XENP018754
SIVMTQSPATLSVSPGERVTLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8603 - protein, 5 aa, Artificial Sequence
  Description of Artificial Sequence: Synthetic peptide
  XENP018754 vhCDR1
NYWMN

SEQ ID NO: 8604 - protein, 19 aa, Artificial Sequence
  Description of Artificial Sequence: Synthetic peptide
  XENP018754 vhCDR2
EIRLKSNNYATHYAEPVKG

SEQ ID NO: 8605 - protein, 11 aa, Artificial Sequence
  Description of Artificial Sequence: Synthetic peptide
  XENP018754 vhCDR3
YYGNYGGYFDV

SEQ ID NO: 8606 - protein, 11 aa, Artificial Sequence
  Description of Artificial Sequence: Synthetic peptide
  XENP018754 vlCDR1
RASQSVSNDVA

SEQ ID NO: 8607 - protein, 7 aa, Artificial Sequence
  Description of Artificial Sequence: Synthetic peptide
  XENP018754 vlCDR2
YASHRYT

SEQ ID NO: 8608 - protein, 9 aa, Artificial Sequence
  Description of Artificial Sequence: Synthetic peptide
  XENP018754 vlCDR3
QQDYSSPRT

SEQ ID NO: 8609 - protein, 249 aa, Artificial Sequence
  Description of Artificial Sequence: Synthetic polypeptide
  XENP018755 1G6_H1_L1.13_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATISCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8610 - protein, 122 aa, Artificial Sequence; identical to SEQ ID NO: 6246
  Description of Artificial Sequence: Synthetic polypeptide
  VH of XENP018755

SEQ ID NO: 8611 - protein, 107 aa, Artificial Sequence
  Description of Artificial Sequence: Synthetic polypeptide
  VL of XENP018755
SIVMTQSPATLSVSPGERATISCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8612 - protein, 5 aa, Artificial Sequence
  Description of Artificial Sequence: Synthetic peptide
  XENP018755 vhCDR1
NYWMN

SEQ ID NO: 8613 - protein, 19 aa, Artificial Sequence
  Description of Artificial Sequence: Synthetic peptide
  XENP018755 vhCDR2
EIRLKSNNYATHYAEPVKG

SEQ ID NO: 8614 - protein, 11 aa, Artificial Sequence
  Description of Artificial Sequence: Synthetic peptide
  XENP018755 vhCDR3
YYGNYGGYFDV

SEQ ID NO: 8615 - protein, 11 aa, Artificial Sequence
  Description of Artificial Sequence: Synthetic peptide
  XENP018755 vlCDR1
RASQSVSNDVA

SEQ ID NO: 8616 - protein, 7 aa, Artificial Sequence
  Description of Artificial Sequence: Synthetic peptide
  XENP018755 vlCDR2
YASHRYT

SEQ ID NO: 8617 - protein, 9 aa, Artificial Sequence
  Description of Artificial Sequence: Synthetic peptide
  XENP018755 vlCDR3
QQDYSSPRT

SEQ ID NO: 8618 - protein, 249 aa, Artificial Sequence
  Description of Artificial Sequence: Synthetic polypeptide
  XENP018756 1G6_H1_L1.14_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLTCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8619 - protein, 122 aa, Artificial Sequence; identical to SEQ ID NO: 6246
  Description of Artificial Sequence: Synthetic polypeptide
  VH of XENP018756

SEQ ID NO: 8620 - protein, 107 aa, Artificial Sequence
  Description of Artificial Sequence: Synthetic polypeptide
  VL of XENP018756
SIVMTQSPATLSVSPGERATLTCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8621 - protein, 5 aa, Artificial Sequence
  Description of Artificial Sequence: Synthetic peptide
  XENP018756 vhCDR1
NYWMN

SEQ ID NO: 8622 - protein, 19 aa, Artificial Sequence
  Description of Artificial Sequence: Synthetic peptide
  XENP018756 vhCDR2
EIRLKSNNYATHYAEPVKG

SEQ ID NO: 8623 - protein, 11 aa, Artificial Sequence
  Description of Artificial Sequence: Synthetic peptide
  XENP018756 vhCDR3
YYGNYGGYFDV

SEQ ID NO: 8624 - protein, 11 aa, Artificial Sequence
  Description of Artificial Sequence: Synthetic peptide
  XENP018756 vlCDR1
RASQSVSNDVA

SEQ ID NO: 8625 - protein, 7 aa, Artificial Sequence
  Description of Artificial Sequence: Synthetic peptide
  XENP018756 vlCDR2
YASHRYT

SEQ ID NO: 8626 - protein, 9 aa, Artificial Sequence
  Description of Artificial Sequence: Synthetic peptide
  XENP018756 vlCDR3
QQDYSSPRT

SEQ ID NO: 8627 - protein, 249 aa, Artificial Sequence
  Description of Artificial Sequence: Synthetic polypeptide
  XENP018757 1G6_H1_L1.15_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCKASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8628 - protein, 122 aa, Artificial Sequence; identical to SEQ ID NO: 6246
  Description of Artificial Sequence: Synthetic polypeptide
  VH of XENP018757

SEQ ID NO: 8629 - protein, 107 aa, Artificial Sequence
  Description of Artificial Sequence: Synthetic polypeptide
  VL of XENP018757
SIVMTQSPATLSVSPGERATLSCKASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 8630 - protein, 5 aa, Artificial Sequence
  Description of Artificial Sequence: Synthetic peptide
  XENP018757 vhCDR1
NYWMN

SEQ ID NO: 8631 - protein, 19 aa, Artificial Sequence
  Description of Artificial Sequence: Synthetic peptide
  XENP018757 vhCDR2
EIRLKSNNYATHYAEPVKG

SEQ ID NO: 8632 - protein, 11 aa, Artificial Sequence
  Description of Artificial Sequence: Synthetic peptide
  XENP018757 vhCDR3
YYGNYGGYFDV

SEQ ID NO: 8633 - protein, 11 aa, Artificial Sequence
  Description of Artificial Sequence: Synthetic peptide
  XENP018757 vlCDR1
KASQSVSNDVA

SEQ ID NO: 8634 - protein, 7 aa, Artificial Sequence
  Description of Artificial Sequence: Synthetic peptide
  XENP018757 vlCDR2
YASHRYT

SEQ ID NO: 8635 - protein, 9 aa, Artificial Sequence
  Description of Artificial Sequence: Synthetic peptide
  XENP018757 vlCDR3
QQDYSSPRT

SEQ ID NO: 8636 - protein, 249 aa, Artificial Sequence
  Description of Artificial Sequence: Synthetic polypeptide
  XENP018758 1G6_H1_L1.16_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQDVSNDVAWYQQKPGQSPRLLINYASHRYTGVPDRFTGSGYGTEFTLTISSLQSEDFAVYFCQQDYSSPRTFGGGTKVEIK

SEQ ID NO: 8637 - protein, 122 aa, Artificial Sequence; identical to SEQ ID NO: 6246
  Description of Artificial Sequence: Synthetic polypeptide
  VH of XENP018758

SEQ ID NO: 8638 - protein, 107 aa, Artificial Sequence
  Description of Artificial Sequence: Synthetic polypeptide
  VL of XENP018758
SIVMTQSPATLSVSPGERATLSCRASQDVSNDVAWYQQKPGQSPRLLINYASHRYTGVPDRFTGSGYGTEFTLTISSLQSEDFAVYFCQQDYSSPRTFGGGTKVEIK

SEQ ID NO: 8639 - protein, 5 aa, Artificial Sequence
  Description of Artificial Sequence: Synthetic peptide
  XENP018758 vhCDR1
NYWMN

SEQ ID NO: 8640 - protein, 19 aa, Artificial Sequence
  Description of Artificial Sequence: Synthetic peptide
  XENP018758 vhCDR2
EIRLKSNNYATHYAEPVKG

SEQ ID NO: 8641 - protein, 11 aa, Artificial Sequence
  Description of Artificial Sequence: Synthetic peptide
  XENP018758 vhCDR3
YYGNYGGYFDV

SEQ ID NO: 8642 - protein, 11 aa, Artificial Sequence
  Description of Artificial Sequence: Synthetic peptide
  XENP018758 vlCDR1
RASQDVSNDVA

SEQ ID NO: 8643 - protein, 7 aa, Artificial Sequence
  Description of Artificial Sequence: Synthetic peptide
  XENP018758 vlCDR2
YASHRYT

SEQ ID NO: 8644 - protein, 9 aa, Artificial Sequence
  Description of Artificial Sequence: Synthetic peptide
  XENP018758 vlCDR3
QQDYSSPRT

SEQ ID NO: 8645 - protein, 249 aa, Artificial Sequence
  Description of Artificial Sequence: Synthetic polypeptide
  XENP018759 1G6_H1_L1.17_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQGVSNDVAWYQQKPGQSPRLLINYASHRYTGVPDRFTGSGYGTEFTLTISSLQSEDFAVYFCQQDYSSPRTFGGGTKVEIK

SEQ ID NO: 8646 - protein, 122 aa, Artificial Sequence; identical to SEQ ID NO: 6246
  Description of Artificial Sequence: Synthetic polypeptide
  VH of XENP018759

SEQ ID NO: 8647 - protein, 107 aa, Artificial Sequence
  Description of Artificial Sequence: Synthetic polypeptide
  VL of XENP018759
SIVMTQSPATLSVSPGERATLSCRASQGVSNDVAWYQQKPGQSPRLLINYASHRYTGVPDRFTGSGYGTEFTLTISSLQSEDFAVYFCQQDYSSPRTFGGGTKVEIK

SEQ ID NO: 8648 - protein, 5 aa, Artificial Sequence
  Description of Artificial Sequence: Synthetic peptide
  XENP018759 vhCDR1
NYWMN

SEQ ID NO: 8649 - protein, 19 aa, Artificial Sequence
  Description of Artificial Sequence: Synthetic peptide
  XENP018759 vhCDR2
EIRLKSNNYATHYAEPVKG

SEQ ID NO: 8650 - protein, 11 aa, Artificial Sequence
  Description of Artificial Sequence: Synthetic peptide
  XENP018759 vhCDR3
YYGNYGGYFDV

SEQ ID NO: 8651 - protein, 11 aa, Artificial Sequence
  Description of Artificial Sequence: Synthetic peptide
  XENP018759 vlCDR1
RASQGVSNDVA

SEQ ID NO: 8652 - protein, 7 aa, Artificial Sequence
  Description of Artificial Sequence: Synthetic peptide
  XENP018759 vlCDR2
YASHRYT

SEQ ID NO: 8653 - protein, 9 aa, Artificial Sequence
  Description of Artificial Sequence: Synthetic peptide
  XENP018759 vlCDR3
QQDYSSPRT

SEQ ID NO: 8654 - protein, 249 aa, Artificial Sequence
  Description of Artificial Sequence: Synthetic polypeptide
  XENP018760 1G6_H1_L1.18_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSISNDVAWYQQKPGQSPRLLINYASHRYTGVPDRFTGSGYGTEFTLTISSLQSEDFAVYFCQQDYSSPRTFGGGTKVEIK

SEQ ID NO: 8655 - protein, 122 aa, Artificial Sequence; identical to SEQ ID NO: 6246
  Description of Artificial Sequence: Synthetic polypeptide
  VH of XENP018760

SEQ ID NO: 8656 - protein, 107 aa, Artificial Sequence
  Description of Artificial Sequence: Synthetic polypeptide
  VL of XENP018760
SIVMTQSPATLSVSPGERATLSCRASQSISNDVAWYQQKPGQSPRLLINYASHRYTGVPDRFTGSGYGTEFTLTISSLQSEDFAVYFCQQDYSSPRTFGGGTKVEIK

SEQ ID NO: 8657 - protein, 5 aa, Artificial Sequence
  Description of Artificial Sequence: Synthetic peptide
  XENP018760 vhCDR1
NYWMN

SEQ ID NO: 8658 - protein, 19 aa, Artificial Sequence
  Description of Artificial Sequence: Synthetic peptide
  XENP018760 vhCDR2
EIRLKSNNYATHYAEPVKG

SEQ ID NO: 8659 - protein, 11 aa, Artificial Sequence
  Description of Artificial Sequence: Synthetic peptide
  XENP018760 vhCDR3
YYGNYGGYFDV

SEQ ID NO: 8660 - protein, 11 aa, Artificial Sequence
  Description of Artificial Sequence: Synthetic peptide
  XENP018760 vlCDR1
RASQSISNDVA

SEQ ID NO: 8661 - protein, 7 aa, Artificial Sequence
  Description of Artificial Sequence: Synthetic peptide
  XENP018760 vlCDR2
YASHRYT

SEQ ID NO: 8662 - protein, 9 aa, Artificial Sequence
  Description of Artificial Sequence: Synthetic peptide
  XENP018760 vlCDR3
QQDYSSPRT

SEQ ID NO: 8663 - protein, 249 aa, Artificial Sequence
  Description of Artificial Sequence: Synthetic polypeptide
  XENP018761 1G6_H1_L1.19_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSLSNDVAWYQQKPGQSPRLLINYASHRYTGVPDRFTGSGYGTEFTLTISSLQSEDFAVYFCQQDYSSPRTFGGGTKVEIK

SEQ ID NO: 8664 - protein, 122 aa, Artificial Sequence; identical to SEQ ID NO: 6246
  Description of Artificial Sequence: Synthetic polypeptide
  VH of XENP018761

SEQ ID NO: 8665 - protein, 107 aa, Artificial Sequence
  Description of Artificial Sequence: Synthetic polypeptide
  VL of XENP018761
SIVMTQSPATLSVSPGERATLSCRASQSLSNDVAWYQQKPGQSPRLLINYASHRYTGVPDRFTGSGYGTEFTLTISSLQSEDFAVYFCQQDYSSPRTFGGGTKVEIK

SEQ ID NO: 8666 - protein, 5 aa, Artificial Sequence
  Description of Artificial Sequence: Synthetic peptide
  XENP018761 vhCDR1
NYWMN

SEQ ID NO: 8667 - protein, 19 aa, Artificial Sequence
  Description of Artificial Sequence: Synthetic peptide
  XENP018761 vhCDR2
EIRLKSNNYATHYAEPVKG

SEQ ID NO: 8668 - protein, 11 aa, Artificial Sequence
  Description of Artificial Sequence: Synthetic peptide
  XENP018761 vhCDR3
YYGNYGGYFDV

SEQ ID NO: 8669 - protein, 11 aa, Artificial Sequence
  Description of Artificial Sequence: Synthetic peptide
  XENP018761 vlCDR1
RASQSLSNDVA

SEQ ID NO: 8670 - protein, 7 aa, Artificial Sequence
  Description of Artificial Sequence: Synthetic peptide
  XENP018761 vlCDR2
YASHRYT

SEQ ID NO: 8671 - protein, 9 aa, Artificial Sequence
  Description of Artificial Sequence: Synthetic peptide
  XENP018761 vlCDR3
QQDYSSPRT

SEQ ID NO: 8672 - protein, 249 aa, Artificial Sequence
  Description of Artificial Sequence: Synthetic polypeptide
  XENP018762 1G6_H1_L1.20_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVTNDVAWYQQKPGQSPRLLINYASHRYTGVPDRFTGSGYGTEFTLTISSLQSEDFAVYFCQQDYSSPRTFGGGTKVEIK

SEQ ID NO: 8673 - protein, 122 aa, Artificial Sequence; identical to SEQ ID NO: 6246
  Description of Artificial Sequence: Synthetic polypeptide
  VH of XENP018762

SEQ ID NO: 8674 - protein, 107 aa, Artificial Sequence
  Description of Artificial Sequence: Synthetic polypeptide
  VL of XENP018762
SIVMTQSPATLSVSPGERATLSCRASQSVTNDVAWYQQKPGQSPRLLINYASHRYTGVPDRFTGSGYGTEFTLTISSLQSEDFAVYFCQQDYSSPRTFGGGTKVEIK

SEQ ID NO: 8675 - protein, 5 aa, Artificial Sequence
  Description of Artificial Sequence: Synthetic peptide
  XENP018762 vhCDR1
NYWMN

SEQ ID NO: 8676 - protein, 19 aa, Artificial Sequence
  Description of Artificial Sequence: Synthetic peptide
  XENP018762 vhCDR2
EIRLKSNNYATHYAEPVKG

SEQ ID NO: 8677 - protein, 11 aa, Artificial Sequence
  Description of Artificial Sequence: Synthetic peptide
  XENP018762 vhCDR3
YYGNYGGYFDV

SEQ ID NO: 8678 - protein, 11 aa, Artificial Sequence
  Description of Artificial Sequence: Synthetic peptide
  XENP018762 vlCDR1
RASQSVTNDVA

SEQ ID NO: 8679 - protein, 7 aa, Artificial Sequence
  Description of Artificial Sequence: Synthetic peptide
  XENP018762 vlCDR2
YASHRYT

SEQ ID NO: 8680 - protein, 9 aa, Artificial Sequence
  Description of Artificial Sequence: Synthetic peptide
  XENP018762 vlCDR3
QQDYSSPRT

SEQ ID NO: 8681 - protein, 249 aa, Artificial Sequence
  Description of Artificial Sequence: Synthetic polypeptide
  XENP018763 1G6_H1_L1.21_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVANDVAWYQQKPGQSPRLLINYASHRYTGVPDRFTGSGYGTEFTLTISSLQSEDFAVYFCQQDYSSPRTFGGGTKVEIK

SEQ ID NO: 8682 - protein, 122 aa, Artificial Sequence; identical to SEQ ID NO: 6246
  Description of Artificial Sequence: Synthetic polypeptide
  VH of XENP018763

SEQ ID NO: 8683 - protein, 107 aa, Artificial Sequence
  Description of Artificial Sequence: Synthetic polypeptide
  VL of XENP018763
SIVMTQSPATLSVSPGERATLSCRASQSVANDVAWYQQKPGQSPRLLINYASHRYTGVPDRFTGSGYGTEFTLTISSLQSEDFAVYFCQQDYSSPRTFGGGTKVEIK

SEQ ID NO: 8684 - protein, 5 aa, Artificial Sequence
  Description of Artificial Sequence: Synthetic peptide
  XENP018763 vhCDR1
NYWMN

SEQ ID NO: 8685 - protein, 19 aa, Artificial Sequence
  Description of Artificial Sequence: Synthetic peptide
  XENP018763 vhCDR2
EIRLKSNNYATHYAEPVKG

SEQ ID NO: 8686 - protein, 11 aa, Artificial Sequence
  Description of Artificial Sequence: Synthetic peptide
  XENP018763 vhCDR3
YYGNYGGYFDV

SEQ ID NO: 8687 - protein, 11 aa, Artificial Sequence
  Description of Artificial Sequence: Synthetic peptide
  XENP018763 vlCDR1
RASQSVANDVA

SEQ ID NO: 8688 - protein, 7 aa, Artificial Sequence
  Description of Artificial Sequence: Synthetic peptide
  XENP018763 vlCDR2
YASHRYT

SEQ ID NO: 8689 - protein, 9 aa, Artificial Sequence
  Description of Artificial Sequence: Synthetic peptide
  XENP018763 vlCDR3
QQDYSSPRT

SEQ ID NO: 8690 - protein, 249 aa, Artificial Sequence
  Description of Artificial Sequence: Synthetic polypeptide
  XENP018764 1G6_H1_L1.22_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVQNDVAWYQQKPGQSPRLLINYASHRYTGVPDRFTGSGYGTEFTLTISSLQSEDFAVYFCQQDYSSPRTFGGGTKVEIK

SEQ ID NO: 8691 - protein, 122 aa, Artificial Sequence; identical to SEQ ID NO: 6246
  Description of Artificial Sequence: Synthetic polypeptide
  VH of XENP018764

SEQ ID NO: 8692 - protein, 107 aa, Artificial Sequence
  Description of Artificial Sequence: Synthetic polypeptide
  VL of XENP018764
SIVMTQSPATLSVSPGERATLSCRASQSVQNDVAWYQQKPGQSPRLLINYASHRYTGVPDRFTGSGYGTEFTLTISSLQSEDFAVYFCQQDYSSPRTFGGGTKVEIK

SEQ ID NO: 8693 - protein, 5 aa, Artificial Sequence
  Description of Artificial Sequence: Synthetic peptide
  XENP018764 vhCDR1
NYWMN

SEQ ID NO: 8694 - protein, 19 aa, Artificial Sequence
  Description of Artificial Sequence: Synthetic peptide
  XENP018764 vhCDR2
EIRLKSNNYATHYAEPVKG

SEQ ID NO: 8695 - protein, 11 aa, Artificial Sequence
  Description of Artificial Sequence: Synthetic peptide
  XENP018764 vhCDR3
YYGNYGGYFDV

SEQ ID NO: 8696 - protein, 11 aa, Artificial Sequence
  Description of Artificial Sequence: Synthetic peptide
  XENP018764 vlCDR1
RASQSVQNDVA

SEQ ID NO: 8697 - protein, 7 aa, Artificial Sequence
  Description of Artificial Sequence: Synthetic peptide
  XENP018764 vlCDR2
YASHRYT

SEQ ID NO: 8698 - protein, 9 aa, Artificial Sequence
  Description of Artificial Sequence: Synthetic peptide
  XENP018764 vlCDR3
QQDYSSPRT

SEQ ID NO: 8699 - protein, 249 aa, Artificial Sequence
  Description of Artificial Sequence: Synthetic polypeptide
  XENP018765 1G6_H1_L1.23_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVGNDVAWYQQKPGQSPRLLINYASHRYTGVPDRFTGSGYGTEFTLTISSLQSEDFAVYFCQQDYSSPRTFGGGTKVEIK

SEQ ID NO: 8700 - protein, 122 aa, Artificial Sequence; identical to SEQ ID NO: 6246
  Description of Artificial Sequence: Synthetic polypeptide
  VH of XENP018765

SEQ ID NO: 8701 - protein, 107 aa, Artificial Sequence
  Description of Artificial Sequence: Synthetic polypeptide
  VL of XENP018765
SIVMTQSPATLSVSPGERATLSCRASQSVGNDVAWYQQKPGQSPRLLINYASHRYTGVPDRFTGSGYGTEFTLTISSLQSEDFAVYFCQQDYSSPRTFGGGTKVEIK

SEQ ID NO: 8702 - protein, 5 aa, Artificial Sequence
  Description of Artificial Sequence: Synthetic peptide
  XENP018765 vhCDR1
NYWMN

SEQ ID NO: 8703 - protein, 19 aa, Artificial Sequence
  Description of Artificial Sequence: Synthetic peptide
  XENP018765 vhCDR2
EIRLKSNNYATHYAEPVKG

SEQ ID NO: 8704 - protein, 11 aa, Artificial Sequence
  Description of Artificial Sequence: Synthetic peptide
  XENP018765 vhCDR3
YYGNYGGYFDV

SEQ ID NO: 8705 - protein, 11 aa, Artificial Sequence
  Description of Artificial Sequence: Synthetic peptide
  XENP018765 vlCDR1
RASQSVGNDVA

SEQ ID NO: 8706 - protein, 7 aa, Artificial Sequence
  Description of Artificial Sequence: Synthetic peptide
  XENP018765 vlCDR2
YASHRYT

SEQ ID NO: 8707 - protein, 9 aa, Artificial Sequence
  Description of Artificial Sequence: Synthetic peptide
  XENP018765 vlCDR3
QQDYSSPRT

SEQ ID NO: 8708 - protein, 249 aa, Artificial Sequence
  Description of Artificial Sequence: Synthetic polypeptide
  XENP018766 1G6_H1_L1.24_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVVNDVAWYQQKPGQSPRLLINYASHRYTGVPDRFTGSGYGTEFTLTISSLQSEDFAVYFCQQDYSSPRTFGGGTKVEIK

SEQ ID NO: 8709 - protein, 122 aa, Artificial Sequence; identical to SEQ ID NO: 6246
  Description of Artificial Sequence: Synthetic polypeptide
  VH of XENP018766

SEQ ID NO: 8710 - protein, 107 aa, Artificial Sequence
  Description of Artificial Sequence: Synthetic polypeptide
  VL of XENP018766
SIVMTQSPATLSVSPGERATLSCRASQSVVNDVAWYQQKPGQSPRLLINYASHRYTGVPDRFTGSGYGTEFTLTISSLQSEDFAVYFCQQDYSSPRTFGGGTKVEIK

SEQ ID NO: 8711 - protein, 5 aa, Artificial Sequence
  Description of Artificial Sequence: Synthetic peptide
  XENP018766 vhCDR1
NYWMN

SEQ ID NO: 8712 - protein, 19 aa, Artificial Sequence
  Description of Artificial Sequence: Synthetic peptide
  XENP018766 vhCDR2
EIRLKSNNYATHYAEPVKG

SEQ ID NO: 8713 - protein, 11 aa, Artificial Sequence
  Description of Artificial Sequence: Synthetic peptide
  XENP018766 vhCDR3
YYGNYGGYFDV

SEQ ID NO: 8714 - protein, 11 aa, Artificial Sequence
  Description of Artificial Sequence: Synthetic peptide
  XENP018766 vlCDR1
RASQSVVNDVA

SEQ ID NO: 8715 - protein, 7 aa, Artificial Sequence
  Description of Artificial Sequence: Synthetic peptide
  XENP018766 vlCDR2
YASHRYT

SEQ ID NO: 8716 - protein, 9 aa, Artificial Sequence
  Description of Artificial Sequence: Synthetic peptide
  XENP018766 vlCDR3
QQDYSSPRT

SEQ ID NO: 8717 - protein, 249 aa, Artificial Sequence
  Description of Artificial Sequence: Synthetic polypeptide
  XENP018767 1G6_H1_L1.25_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVHNDVAWYQQKPGQSPRLLINYASHRYTGVPDRFTGSGYGTEFTLTISSLQSEDFAVYFCQQDYSSPRTFGGGTKVEIK

SEQ ID NO: 8718 - protein, 122 aa, Artificial Sequence; identical to SEQ ID NO: 6246
  Description of Artificial Sequence: Synthetic polypeptide
  VH of XENP018767

SEQ ID NO: 8719 - protein, 107 aa, Artificial Sequence
  Description of Artificial Sequence: Synthetic polypeptide
  VL of XENP018767
SIVMTQSPATLSVSPGERATLSCRASQSVHNDVAWYQQKPGQSPRLLINYASHRYTGVPDRFTGSGYGTEFTLTISSLQSEDFAVYFCQQDYSSPRTFGGGTKVEIK

SEQ ID NO: 8720 - protein, 5 aa, Artificial Sequence
  Description of Artificial Sequence: Synthetic peptide
  XENP018767 vhCDR1
NYWMN

SEQ ID NO: 8721 - protein, 19 aa, Artificial Sequence
  Description of Artificial Sequence: Synthetic peptide
  XENP018767 vhCDR2
EIRLKSNNYATHYAEPVKG

SEQ ID NO: 8722 - protein, 11 aa, Artificial Sequence
  Description of Artificial Sequence: Synthetic peptide
  XENP018767 vhCDR3
YYGNYGGYFDV

SEQ ID NO: 8723 - protein, 11 aa, Artificial Sequence
  Description of Artificial Sequence: Synthetic peptide
  XENP018767 vlCDR1
RASQSVHNDVA

SEQ ID NO: 8724 - protein, 7 aa, Artificial Sequence
  Description of Artificial Sequence: Synthetic peptide
  XENP018767 vlCDR2
YASHRYT

SEQ ID NO: 8725 - protein, 9 aa, Artificial Sequence
  Description of Artificial Sequence: Synthetic peptide
  XENP018767 vlCDR3
QQDYSSPRT

SEQ ID NO: 8726 - protein, 249 aa, Artificial Sequence
  Description of Artificial Sequence: Synthetic polypeptide
  XENP018768 1G6_H1_L1.26_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVDNDVAWYQQKPGQSPRLLINYASHRYTGVPDRFTGSGYGTEFTLTISSLQSEDFAVYFCQQDYSSPRTFGGGTKVEIK

SEQ ID NO: 8727 - protein, 122 aa, Artificial Sequence; identical to SEQ ID NO: 6246
  Description of Artificial Sequence: Synthetic polypeptide
  VH of XENP018768

SEQ ID NO: 8728 - protein, 107 aa, Artificial Sequence
  Description of Artificial Sequence: Synthetic polypeptide
  VL of XENP018768
SIVMTQSPATLSVSPGERATLSCRASQSVDNDVAWYQQKPGQSPRLLINYASHRYTGVPDRFTGSGYGTEFTLTISSLQSEDFAVYFCQQDYSSPRTFGGGTKVEIK

SEQ ID NO: 8729 - protein, 5 aa, Artificial Sequence
  Description of Artificial Sequence: Synthetic peptide
  XENP018768 vhCDR1
NYWMN

SEQ ID NO: 8730 - protein, 19 aa, Artificial Sequence
  Description of Artificial Sequence: Synthetic peptide
  XENP018768 vhCDR2
EIRLKSNNYATHYAEPVKG

SEQ ID NO: 8731 - protein, 11 aa, Artificial Sequence
  Description of Artificial Sequence: Synthetic peptide
  XENP018768 vhCDR3
YYGNYGGYFDV

SEQ ID NO: 8732 - protein, 11 aa, Artificial Sequence
  Description of Artificial Sequence: Synthetic peptide
  XENP018768 vlCDR1
RASQSVDNDVA

SEQ ID NO: 8733 - protein, 7 aa, Artificial Sequence
  Description of Artificial Sequence: Synthetic peptide
  XENP018768 vlCDR2
YASHRYT

SEQ ID NO: 8734 - protein, 9 aa, Artificial Sequence
  Description of Artificial Sequence: Synthetic peptide
  XENP018768 vlCDR3
QQDYSSPRT

SEQ ID NO: 8735 - protein, 249 aa, Artificial Sequence
  Description of Artificial Sequence: Synthetic polypeptide
  XENP018769 1G6_H1_L1.27_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVKNDVAWYQQKPGQSPRLLINYASHRYTGVPDRFTGSGYGTEFTLTISSLQSEDFAVYFCQQDYSSPRTFGGGTKVEIK

SEQ ID NO: 8736 - protein, 122 aa, Artificial Sequence; identical to SEQ ID NO: 6246
  Description of Artificial Sequence: Synthetic polypeptide
  VH of XENP018769

SEQ ID NO: 8737 - protein, 107 aa, Artificial Sequence
  Description of Artificial Sequence: Synthetic polypeptide
  VL of XENP018769
SIVMTQSPATLSVSPGERATLSCRASQSVKNDVAWYQQKPGQSPRLLINYASHRYTGVPDRFTGSGYGTEFTLTISSLQSEDFAVYFCQQDYSSPRTFGGGTKVEIK

SEQ ID NO: 8738 - protein, 5 aa, Artificial Sequence
  Description of Artificial Sequence: Synthetic peptide
  XENP018769 vhCDR1
NYWMN

SEQ ID NO: 8739 - protein, 19 aa, Artificial Sequence
  Description of Artificial Sequence: Synthetic peptide
  XENP018769 vhCDR2
EIRLKSNNYATHYAEPVKG

SEQ ID NO: 8740 - protein, 11 aa, Artificial Sequence
  Description of Artificial Sequence: Synthetic peptide
  XENP018769 vhCDR3
YYGNYGGYFDV

SEQ ID NO: 8741 - protein, 11 aa, Artificial Sequence
  Description of Artificial Sequence: Synthetic peptide
  XENP018769 vlCDR1
RASQSVKNDVA

SEQ ID NO: 8742 - protein, 7 aa, Artificial Sequence
  Description of Artificial Sequence: Synthetic peptide
  XENP018769 vlCDR2
YASHRYT

SEQ ID NO: 8743 - protein, 9 aa, Artificial Sequence
  Description of Artificial Sequence: Synthetic peptide
  XENP018769 vlCDR3
QQDYSSPRT

SEQ ID NO: 8744 - protein, 249 aa, Artificial Sequence
  Description of Artificial Sequence: Synthetic polypeptide
  XENP018770 1G6_H1_L1.28_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVYNDVAWYQQKPGQSPRLLINYASHRYTGVPDRFTGSGYGTEFTLTISSLQSEDFAVYFCQQDYSSPRTFGGGTKVEIK

SEQ ID NO: 8745 - protein, 122 aa, Artificial Sequence; identical to SEQ ID NO: 6246
  Description of Artificial Sequence: Synthetic polypeptide
  VH of XENP018770

SEQ ID NO: 8746 - protein, 107 aa, Artificial Sequence
  Description of Artificial Sequence: Synthetic polypeptide
  VL of XENP018770
SIVMTQSPATLSVSPGERATLSCRASQSVYNDVAWYQQKPGQSPRLLINYASHRYTGVPDRFTGSGYGTEFTLTISSLQSEDFAVYFCQQDYSSPRTFGGGTKVEIK

SEQ ID NO: 8747 - protein, 5 aa, Artificial Sequence
  Description of Artificial Sequence: Synthetic peptide
  XENP018770 vhCDR1
NYWMN

SEQ ID NO: 8748 - protein, 19 aa, Artificial Sequence
  Description of Artificial Sequence: Synthetic peptide
  XENP018770 vhCDR2
EIRLKSNNYATHYAEPVKG

SEQ ID NO: 8749 - protein, 11 aa, Artificial Sequence
  Description of Artificial Sequence: Synthetic peptide
  XENP018770 vhCDR3
YYGNYGGYFDV

SEQ ID NO: 8750 - protein, 11 aa, Artificial Sequence
  Description of Artificial Sequence: Synthetic peptide
  XENP018770 vlCDR1
RASQSVYNDVA

SEQ ID NO: 8751 - protein, 7 aa, Artificial Sequence
  Description of Artificial Sequence: Synthetic peptide
  XENP018770 vlCDR2
YASHRYT

SEQ ID NO: 8752 - protein, 9 aa, Artificial Sequence
  Description of Artificial Sequence: Synthetic peptide
  XENP018770 vlCDR3
QQDYSSPRT

SEQ ID NO: 8753 - protein, 249 aa, Artificial Sequence
  Description of Artificial Sequence: Synthetic polypeptide
  XENP018771 1G6_H1_L1.29_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSDDVAWYQQKPGQSPRLLINYASHRYTGVPDRFTGSGYGTEFTLTISSLQSEDFAVYFCQQDYSSPRTFGGGTKVEIK

SEQ ID NO: 8754 - protein, 122 aa, Artificial Sequence; identical to SEQ ID NO: 6246
  Description of Artificial Sequence: Synthetic polypeptide
  VH of XENP018771

SEQ ID NO: 8755 - protein, 107 aa, Artificial Sequence
  Description of Artificial Sequence: Synthetic polypeptide
  VL of XENP018771
SIVMTQSPATLSVSPGERATLSCRASQSVSDDVAWYQQKPGQSPRLLINYASHRYTGVPDRFTGSGYGTEFTLTISSLQSEDFAVYFCQQDYSSPRTFGGGTKVEIK

SEQ ID NO: 8756 - protein, 5 aa, Artificial Sequence
  Description of Artificial Sequence: Synthetic peptide
  XENP018771 vhCDR1
NYWMN

SEQ ID NO: 8757 - protein, 19 aa, Artificial Sequence
  Description of Artificial Sequence: Synthetic peptide
  XENP018771 vhCDR2
EIRLKSNNYATHYAEPVKG

SEQ ID NO: 8758 - protein, 11 aa, Artificial Sequence
  Description of Artificial Sequence: Synthetic peptide
  XENP018771 vhCDR3
YYGNYGGYFDV

SEQ ID NO: 8759 - protein, 11 aa, Artificial Sequence
  Description of Artificial Sequence: Synthetic peptide
  XENP018771 vlCDR1
RASQSVSDDVA

SEQ ID NO: 8760 - protein, 7 aa, Artificial Sequence
  Description of Artificial Sequence: Synthetic peptide
  XENP018771 vlCDR2
YASHRYT

SEQ ID NO: 8761 - protein, 9 aa, Artificial Sequence
  Description of Artificial Sequence: Synthetic peptide
  XENP018771 vlCDR3
QQDYSSPRT

SEQ ID NO: 8762 - protein, 249 aa, Artificial Sequence
  Description of Artificial Sequence: Synthetic polypeptide
  XENP018772 1G6_H1_L1.30_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSHDVAWYQQKPGQSPRLLINYASHRYTGVPDRFTGSGYGTEFTLTISSLQSEDFAVYFCQQDYSSPRTFGGGTKVEIK

SEQ ID NO: 8763 - protein, 122 aa, Artificial Sequence; identical to SEQ ID NO: 6246
  Description of Artificial Sequence: Synthetic polypeptide
  VH of XENP018772

SEQ ID NO: 8764 - protein, 107 aa, Artificial Sequence
  Description of Artificial Sequence: Synthetic polypeptide
  VL of XENP018772
SIVMTQSPATLSVSPGERATLSCRASQSVSHDVAWYQQKPGQSPRLLINYASHRYTGVPDRFTGSGYGTEFTLTISSLQSEDFAVYFCQQDYSSPRTFGGGTKVEIK

SEQ ID NO: 8765 - protein, 5 aa, Artificial Sequence
  Description of Artificial Sequence: Synthetic peptide
  XENP018772 vhCDR1
NYWMN

SEQ ID NO: 8766 - protein, 19 aa, Artificial Sequence
  Description of Artificial Sequence: Synthetic peptide
  XENP018772 vhCDR2
EIRLKSNNYATHYAEPVKG

SEQ ID NO: 8767 - protein, 11 aa, Artificial Sequence
  Description of Artificial Sequence: Synthetic peptide
  XENP018772 vhCDR3
YYGNYGGYFDV

SEQ ID NO: 8768 - protein, 11 aa, Artificial Sequence
  Description of Artificial Sequence: Synthetic peptide
  XENP018772 vlCDR1
RASQSVSHDVA

SEQ ID NO: 8769 - protein, 7 aa, Artificial Sequence
  Description of Artificial Sequence: Synthetic peptide
  XENP018772 vlCDR2
YASHRYT

SEQ ID NO: 8770 - protein, 9 aa, Artificial Sequence
  Description of Artificial Sequence: Synthetic peptide
  XENP018772 vlCDR3
QQDYSSPRT

SEQ ID NO: 8771 - protein, 249 aa, Artificial Sequence
  Description of Artificial Sequence: Synthetic polypeptide
  XENP018773 1G6_H1_L1.31_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSEDVAWYQQKPGQSPRLLINYASHRYTGVPDRFTGSGYGTEFTLTISSLQSEDFAVYFCQQDYSSPRTFGGGTKVEIK

SEQ ID NO: 8772 - protein, 122 aa, Artificial Sequence; identical to SEQ ID NO: 6246
  Description of Artificial Sequence: Synthetic polypeptide
  VH of XENP018773

SEQ ID NO: 8773 - protein, 107 aa, Artificial Sequence
  Description of Artificial Sequence: Synthetic polypeptide
  VL of XENP018773
SIVMTQSPATLSVSPGERATLSCRASQSVSEDVAWYQQKPGQSPRLLINYASHRYTGVPDRFTGSGYGTEFTLTISSLQSEDFAVYFCQQDYSSPRTFGGGTKVEIK

SEQ ID NO: 8774 - protein, 5 aa, Artificial Sequence
  Description of Artificial Sequence: Synthetic peptide
  XENP018773 vhCDR1
NYWMN

SEQ ID NO: 8775 - protein, 19 aa, Artificial Sequence
  Description of Artificial Sequence: Synthetic peptide
  XENP018773 vhCDR2
EIRLKSNNYATHYAEPVKG

SEQ ID NO: 8776 - protein, 11 aa, Artificial Sequence
  Description of Artificial Sequence: Synthetic peptide
  XENP018773 vhCDR3
YYGNYGGYFDV

SEQ ID NO: 8777 - protein, 11 aa, Artificial Sequence
  Description of Artificial Sequence: Synthetic peptide
  XENP018773 vlCDR1
RASQSVSEDVA

SEQ ID NO: 8778 - protein, 7 aa, Artificial Sequence
  Description of Artificial Sequence: Synthetic peptide
  XENP018773 vlCDR2
YASHRYT

SEQ ID NO: 8779 - protein, 9 aa, Artificial Sequence
  Description of Artificial Sequence: Synthetic peptide
  XENP018773 vlCDR3
QQDYSSPRT

SEQ ID NO: 8780 - protein, 249 aa, Artificial Sequence
  Description of Artificial Sequence: Synthetic polypeptide
  XENP018774 1G6_H1_L1.32_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSSDVAWYQQKPGQSPRLLINYASHRYTGVPDRFTGSGYGTEFTLTISSLQSEDFAVYFCQQDYSSPRTFGGGTKVEIK

SEQ ID NO: 8781 - protein, 122 aa, Artificial Sequence; identical to SEQ ID NO: 6246
  Description of Artificial Sequence: Synthetic polypeptide
  VH of XENP018774

SEQ ID NO: 8782 - protein, 107 aa, Artificial Sequence
  Description of Artificial Sequence: Synthetic polypeptide
  VL of XENP018774
SIVMTQSPATLSVSPGERATLSCRASQSVSSDVAWYQQKPGQSPRLLINYASHRYTGVPDRFTGSGYGTEFTLTISSLQSEDFAVYFCQQDYSSPRTFGGGTKVEIK

SEQ ID NO: 8783 - protein, 5 aa, Artificial Sequence
  Description of Artificial Sequence: Synthetic peptide
  XENP018774 vhCDR1
NYWMN

SEQ ID NO: 8784 - protein, 19 aa, Artificial Sequence
  Description of Artificial Sequence: Synthetic peptide
  XENP018774 vhCDR2
EIRLKSNNYATHYAEPVKG

SEQ ID NO: 8785 - protein, 11 aa, Artificial Sequence
  Description of Artificial Sequence: Synthetic peptide
  XENP018774 vhCDR3
YYGNYGGYFDV

SEQ ID NO: 8786 - protein, 11 aa, Artificial Sequence
  Description of Artificial Sequence: Synthetic peptide
  XENP018774 vlCDR1
RASQSVSSDVA

SEQ ID NO: 8787 - protein, 7 aa, Artificial Sequence
  Description of Artificial Sequence: Synthetic peptide
  XENP018774 vlCDR2
YASHRYT

SEQ ID NO: 8788 - protein, 9 aa, Artificial Sequence
  Description of Artificial Sequence: Synthetic peptide
  XENP018774 vlCDR3
QQDYSSPRT

SEQ ID NO: 8789 - protein, 249 aa, Artificial Sequence
  Description of Artificial Sequence: Synthetic polypeptide
  XENP018775 1G6_H1_L1.33_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSRDVAWYQQKPGQSPRLLINYASHRYTGVPDRFTGSGYGTEFTLTISSLQSEDFAVYFCQQDYSSPRTFGGGTKVEIK

SEQ ID NO: 8790 - protein, 122 aa, Artificial Sequence; identical to SEQ ID NO: 6246
  Description of Artificial Sequence: Synthetic polypeptide
  VH of XENP018775

SEQ ID NO: 8791 - protein, 107 aa, Artificial Sequence
  Description of Artificial Sequence: Synthetic polypeptide
  VL of XENP018775
SIVMTQSPATLSVSPGERATLSCRASQSVSRDVAWYQQKPGQSPRLLINYASHRYTGVPDRFTGSGYGTEFTLTISSLQSEDFAVYFCQQDYSSPRTFGGGTKVEIK

SEQ ID NO: 8792 - protein, 5 aa, Artificial Sequence
  Description of Artificial Sequence: Synthetic peptide
  XENP018775 vhCDR1
NYWMN

SEQ ID NO: 8793 - protein, 19 aa, Artificial Sequence
  Description of Artificial Sequence: Synthetic peptide
  XENP018775 vhCDR2
EIRLKSNNYATHYAEPVKG

SEQ ID NO: 8794 - protein, 11 aa, Artificial Sequence
  Description of Artificial Sequence: Synthetic peptide
  XENP018775 vhCDR3
YYGNYGGYFDV

SEQ ID NO: 8795 - protein, 11 aa, Artificial Sequence
  Description of Artificial Sequence: Synthetic peptide
  XENP018775 vlCDR1
RASQSVSRDVA

SEQ ID NO: 8796 - protein, 7 aa, Artificial Sequence
  Description of Artificial Sequence: Synthetic peptide
  XENP018775 vlCDR2
YASHRYT

SEQ ID NO: 8797 - protein, 9 aa, Artificial Sequence
  Description of Artificial Sequence: Synthetic peptide
  XENP018775 vlCDR3
QQDYSSPRT

SEQ ID NO: 8798 - protein, 249 aa, Artificial Sequence
  Description of Artificial Sequence: Synthetic polypeptide
  XENP018776 1G6_H1_L1.34_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSLDVAWYQQKPGQSPRLLINYASHRYTGVPDRFTGSGYGTEFTLTISSLQSEDFAVYFCQQDYSSPRTFGGGTKVEIK

SEQ ID NO: 8799 - protein, 122 aa, Artificial Sequence; identical to SEQ ID NO: 6246
  Description of Artificial Sequence: Synthetic polypeptide
  VH of XENP018776

SEQ ID NO: 8800 - protein, 107 aa, Artificial Sequence
  Description of Artificial Sequence: Synthetic polypeptide
  VL of XENP018776
SIVMTQSPATLSVSPGERATLSCRASQSVSLDVAWYQQKPGQSPRLLINYASHRYTGVPDRFTGSGYGTEFTLTISSLQSEDFAVYFCQQDYSSPRTFGGGTKVEIK

SEQ ID NO: 8801 - protein, 5 aa, Artificial Sequence
  Description of Artificial Sequence: Synthetic peptide
  XENP018776 vhCDR1
NYWMN

SEQ ID NO: 8802 - protein, 19 aa, Artificial Sequence
  Description of Artificial Sequence: Synthetic peptide
  XENP018776 vhCDR2
EIRLKSNNYATHYAEPVKG

SEQ ID NO: 8803 - protein, 11 aa, Artificial Sequence
  Description of Artificial Sequence: Synthetic peptide
  XENP018776 vhCDR3
YYGNYGGYFDV

SEQ ID NO: 8804 - protein, 11 aa, Artificial Sequence
  Description of Artificial Sequence: Synthetic peptide
  XENP018776 vlCDR1
RASQSVSLDVA

SEQ ID NO: 8805 - protein, 7 aa, Artificial Sequence
  Description of Artificial Sequence: Synthetic peptide
  XENP018776 vlCDR2
YASHRYT

SEQ ID NO: 8806 - protein, 9 aa, Artificial Sequence
  Description of Artificial Sequence: Synthetic peptide
  XENP018776 vlCDR3
QQDYSSPRT

SEQ ID NO: 8807 - protein, 249 aa, Artificial Sequence
  Description of Artificial Sequence: Synthetic polypeptide
  XENP018777 1G6_H1_L1.35_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSTDVAWYQQKPGQSPRLLINYASHRYTGVPDRFTGSGYGTEFTLTISSLQSEDFAVYFCQQDYSSPRTFGGGTKVEIK

SEQ ID NO: 8808 - protein, 122 aa, Artificial Sequence; identical to SEQ ID NO: 6246
  Description of Artificial Sequence: Synthetic polypeptide
  VH of XENP018777

SEQ ID NO: 8809 - protein, 107 aa, Artificial Sequence
  Description of Artificial Sequence: Synthetic polypeptide
  VL of XENP018777
SIVMTQSPATLSVSPGERATLSCRASQSVSTDVAWYQQKPGQSPRLLINYASHRYTGVPDRFTGSGYGTEFTLTISSLQSEDFAVYFCQQDYSSPRTFGGGTKVEIK

SEQ ID NO: 8810 - protein, 5 aa, Artificial Sequence
  Description of Artificial Sequence: Synthetic peptide
  XENP018777 vhCDR1
NYWMN

SEQ ID NO: 8811 - protein, 19 aa, Artificial Sequence
  Description of Artificial Sequence: Synthetic peptide
  XENP018777 vhCDR2
EIRLKSNNYATHYAEPVKG

SEQ ID NO: 8812 - protein, 11 aa, Artificial Sequence
  Description of Artificial Sequence: Synthetic peptide
  XENP018777 vhCDR3
YYGNYGGYFDV

SEQ ID NO: 8813 - protein, 11 aa, Artificial Sequence
  Description of Artificial Sequence: Synthetic peptide
  XENP018777 vlCDR1
RASQSVSTDVA

SEQ ID NO: 8814 - protein, 7 aa, Artificial Sequence
  Description of Artificial Sequence: Synthetic peptide
  XENP018777 vlCDR2
YASHRYT

SEQ ID NO: 8815 - protein, 9 aa, Artificial Sequence
  Description of Artificial Sequence: Synthetic peptide
  XENP018777 vlCDR3
QQDYSSPRT

SEQ ID NO: 8816 - protein, 249 aa, Artificial Sequence
  Description of Artificial Sequence: Synthetic polypeptide
  XENP018778 1G6_H1_L1.36_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSGDVAWYQQKPGQSPRLLINYASHRYTGVPDRFTGSGYGTEFTLTISSLQSEDFAVYFCQQDYSSPRTFGGGTKVEIK

SEQ ID NO: 8817 - protein, 122 aa, Artificial Sequence; identical to SEQ ID NO: 6246
  Description of Artificial Sequence: Synthetic polypeptide
  VH of XENP018778

SEQ ID NO: 8818 - protein, 107 aa, Artificial Sequence
  Description of Artificial Sequence: Synthetic polypeptide
  VL of XENP018778
SIVMTQSPATLSVSPGERATLSCRASQSVSGDVAWYQQKPGQSPRLLINYASHRYTGVPDRFTGSGYGTEFTLTISSLQSEDFAVYFCQQDYSSPRTFGGGTKVEIK

SEQ ID NO: 8819 - protein, 5 aa, Artificial Sequence
  Description of Artificial Sequence: Synthetic peptide
  XENP018778 vhCDR1
NYWMN

SEQ ID NO: 8820 - protein, 19 aa, Artificial Sequence
  Description of Artificial Sequence: Synthetic peptide
  XENP018778 vhCDR2
EIRLKSNNYATHYAEPVKG

SEQ ID NO: 8821 - protein, 11 aa, Artificial Sequence
  Description of Artificial Sequence: Synthetic peptide
  XENP018778 vhCDR3
YYGNYGGYFDV

SEQ ID NO: 8822 - protein, 11 aa, Artificial Sequence
  Description of Artificial Sequence: Synthetic peptide
  XENP018778 vlCDR1
RASQSVSGDVA

SEQ ID NO: 8823 - protein, 7 aa, Artificial Sequence
  Description of Artificial Sequence: Synthetic peptide
  XENP018778 vlCDR2
YASHRYT

SEQ ID NO: 8824 - protein, 9 aa, Artificial Sequence
  Description of Artificial Sequence: Synthetic peptide
  XENP018778 vlCDR3
QQDYSSPRT

SEQ ID NO: 8825 - protein, 249 aa, Artificial Sequence
  Description of Artificial Sequence: Synthetic polypeptide
  XENP018779 1G6_H1_L1.37_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSYDVAWYQQKPGQSPRLLINYASHRYTGVPDRFTGSGYGTEFTLTISSLQSEDFAVYFCQQDYSSPRTFGGGTKVEIK

SEQ ID NO: 8826 - protein, 122 aa, Artificial Sequence; identical to SEQ ID NO: 6246
  Description of Artificial Sequence: Synthetic polypeptide
  VH of XENP018779

SEQ ID NO: 8827 - protein, 107 aa, Artificial Sequence
  Description of Artificial Sequence: Synthetic polypeptide
  VL of XENP018779
SIVMTQSPATLSVSPGERATLSCRASQSVSYDVAWYQQKPGQSPRLLINYASHRYTGVPDRFTGSGYGTEFTLTISSLQSEDFAVYFCQQDYSSPRTFGGGTKVEIK

SEQ ID NO: 8828 - protein, 5 aa, Artificial Sequence
  Description of Artificial Sequence: Synthetic peptide
  XENP018779 vhCDR1
NYWMN

SEQ ID NO: 8829 - protein, 19 aa, Artificial Sequence
  Description of Artificial Sequence: Synthetic peptide
  XENP018779 vhCDR2
EIRLKSNNYATHYAEPVKG

SEQ ID NO: 8830 - protein, 11 aa, Artificial Sequence
  Description of Artificial Sequence: Synthetic peptide
  XENP018779 vhCDR3
YYGNYGGYFDV

SEQ ID NO: 8831 - protein, 11 aa, Artificial Sequence
  Description of Artificial Sequence: Synthetic peptide
  XENP018779 vlCDR1
RASQSVSYDVA

SEQ ID NO: 8832 - protein, 7 aa, Artificial Sequence
  Description of Artificial Sequence: Synthetic peptide
  XENP018779 vlCDR2
YASHRYT

SEQ ID NO: 8833 - protein, 9 aa, Artificial Sequence
  Description of Artificial Sequence: Synthetic peptide
  XENP018779 vlCDR3
QQDYSSPRT

SEQ ID NO: 8834 - protein, 249 aa, Artificial Sequence
  Description of Artificial Sequence: Synthetic polypeptide
  XENP018780 1G6_H1_L1.38_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNNVAWYQQKPGQSPRLLINYASHRYTGVPDRFTGSGYGTEFTLTISSLQSEDFAVYFCQQDYSSPRTFGGGTKVEIK

SEQ ID NO: 8835 - protein, 122 aa, Artificial Sequence; identical to SEQ ID NO: 6246
  Description of Artificial Sequence: Synthetic polypeptide
  VH of XENP018780

SEQ ID NO: 8836 - protein, 107 aa, Artificial Sequence
  Description of Artificial Sequence: Synthetic polypeptide
  VL of XENP018780
SIVMTQSPATLSVSPGERATLSCRASQSVSNNVAWYQQKPGQSPRLLINYASHRYTGVPDRFTGSGYGTEFTLTISSLQSEDFAVYFCQQDYSSPRTFGGGTKVEIK

SEQ ID NO: 8837 - protein, 5 aa, Artificial Sequence
  Description of Artificial Sequence: Synthetic peptide
  XENP018780 vhCDR1
NYWMN

SEQ ID NO: 8838 - protein, 19 aa, Artificial Sequence
  Description of Artificial Sequence: Synthetic peptide
  XENP018780 vhCDR2
EIRLKSNNYATHYAEPVKG

SEQ ID NO: 8839 - protein, 11 aa, Artificial Sequence
  Description of Artificial Sequence: Synthetic peptide
  XENP018780 vhCDR3
YYGNYGGYFDV

SEQ ID NO: 8840 - protein, 11 aa, Artificial Sequence
  Description of Artificial Sequence: Synthetic peptide
  XENP018780 vlCDR1
RASQSVSNNVA

SEQ ID NO: 8841 - protein, 7 aa, Artificial Sequence
  Description of Artificial Sequence: Synthetic peptide
  XENP018780 vlCDR2
YASHRYT

SEQ ID NO: 8842 - protein, 9 aa, Artificial Sequence
  Description of Artificial Sequence: Synthetic peptide
  XENP018780 vlCDR3
QQDYSSPRT

SEQ ID NO: 8843 - protein, 249 aa, Artificial Sequence
  Description of Artificial Sequence: Synthetic polypeptide
  XENP018781 1G6_H1_L1.39_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNEVAWYQQKPGQSPRLLINYASHRYTGVPDRFTGSGYGTEFTLTISSLQSEDFAVYFCQQDYSSPRTFGGGTKVEIK

SEQ ID NO: 8844 - protein, 122 aa, Artificial Sequence; identical to SEQ ID NO: 6246
  Description of Artificial Sequence: Synthetic polypeptide
  VH of XENP018781

SEQ ID NO: 8845 - protein, 107 aa, Artificial Sequence
  Description of Artificial Sequence: Synthetic polypeptide
  VL of XENP018781
SIVMTQSPATLSVSPGERATLSCRASQSVSNEVAWYQQKPGQSPRLLINYASHRYTGVPDRFTGSGYGTEFTLTISSLQSEDFAVYFCQQDYSSPRTFGGGTKVEIK

SEQ ID NO: 8846 - protein, 5 aa, Artificial Sequence
  Description of Artificial Sequence: Synthetic peptide
  XENP018781 vhCDR1
NYWMN

SEQ ID NO: 8847 - protein, 19 aa, Artificial Sequence
  Description of Artificial Sequence: Synthetic peptide
  XENP018781 vhCDR2
EIRLKSNNYATHYAEPVKG

SEQ ID NO: 8848 - protein, 11 aa, Artificial Sequence
  Description of Artificial Sequence: Synthetic peptide
  XENP018781 vhCDR3
YYGNYGGYFDV

SEQ ID NO: 8849 - protein, 11 aa, Artificial Sequence
  Description of Artificial Sequence: Synthetic peptide
  XENP018781 vlCDR1
RASQSVSNEVA

SEQ ID NO: 8850 - protein, 7 aa, Artificial Sequence
  Description of Artificial Sequence: Synthetic peptide
  XENP018781 vlCDR2
YASHRYT

SEQ ID NO: 8851 - protein, 9 aa, Artificial Sequence
  Description of Artificial Sequence: Synthetic peptide
  XENP018781 vlCDR3
QQDYSSPRT

SEQ ID NO: 8852 - protein, 249 aa, Artificial Sequence
  Description of Artificial Sequence: Synthetic polypeptide
  XENP018782 1G6_H1_L1.40_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNHVAWYQQKPGQSPRLLINYASHRYTGVPDRFTGSGYGTEFTLTISSLQSEDFAVYFCQQDYSSPRTFGGGTKVEIK

SEQ ID NO: 8853 - protein, 122 aa, Artificial Sequence; identical to SEQ ID NO: 6246
  Description of Artificial Sequence: Synthetic polypeptide
  VH of XENP018782

SEQ ID NO: 8854 - protein, 107 aa, Artificial Sequence
  Description of Artificial Sequence: Synthetic polypeptide
  VL of XENP018782
SIVMTQSPATLSVSPGERATLSCRASQSVSNHVAWYQQKPGQSPRLLINYASHRYTGVPDRFTGSGYGTEFTLTISSLQSEDFAVYFCQQDYSSPRTFGGGTKVEIK

SEQ ID NO: 8855 - protein, 5 aa, Artificial Sequence
  Description of Artificial Sequence: Synthetic peptide
  XENP018782 vhCDR1
NYWMN

SEQ ID NO: 8856 - protein, 19 aa, Artificial Sequence
  Description of Artificial Sequence: Synthetic peptide
  XENP018782 vhCDR2
EIRLKSNNYATHYAEPVKG

SEQ ID NO: 8857 - protein, 11 aa, Artificial Sequence
  Description of Artificial Sequence: Synthetic peptide
  XENP018782 vhCDR3
YYGNYGGYFDV

SEQ ID NO: 8858 - protein, 11 aa, Artificial Sequence
  Description of Artificial Sequence: Synthetic peptide
  XENP018782 vlCDR1
RASQSVSNHVA

SEQ ID NO: 8859 - protein, 7 aa, Artificial Sequence
  Description of Artificial Sequence: Synthetic peptide
  XENP018782 vlCDR2
YASHRYT

SEQ ID NO: 8860 - protein, 9 aa, Artificial Sequence
  Description of Artificial Sequence: Synthetic peptide
  XENP018782 vlCDR3
QQDYSSPRT

SEQ ID NO: 8861 - protein, 249 aa, Artificial Sequence
  Description of Artificial Sequence: Synthetic polypeptide
  XENP018783 1G6_H1_L1.41_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNSVAWYQQKPGQSPRLLINYASHRYTGVPDRFTGSGYGTEFTLTISSLQSEDFAVYFCQQDYSSPRTFGGGTKVEIK

SEQ ID NO: 8862 - protein, 122 aa, Artificial Sequence; identical to SEQ ID NO: 6246
  Description of Artificial Sequence: Synthetic polypeptide
  VH of XENP018783

SEQ ID NO: 8863 - protein, 107 aa, Artificial Sequence
  Description of Artificial Sequence: Synthetic polypeptide
  VL of XENP018783
SIVMTQSPATLSVSPGERATLSCRASQSVSNSVAWYQQKPGQSPRLLINYASHRYTGVPDRFTGSGYGTEFTLTISSLQSEDFAVYFCQQDYSSPRTFGGGTKVEIK

SEQ ID NO: 8864 - protein, 5 aa, Artificial Sequence
  Description of Artificial Sequence: Synthetic peptide
  XENP018783 vhCDR1
NYWMN

SEQ ID NO: 8865 - protein, 19 aa, Artificial Sequence
  Description of Artificial Sequence: Synthetic peptide
  XENP018783 vhCDR2
EIRLKSNNYATHYAEPVKG

SEQ ID NO: 8866 - protein, 11 aa, Artificial Sequence
  Description of Artificial Sequence: Synthetic peptide
  XENP018783 vhCDR3
YYGNYGGYFDV

SEQ ID NO: 8867 - protein, 11 aa, Artificial Sequence
  Description of Artificial Sequence: Synthetic peptide
  XENP018783 vlCDR1
RASQSVSNSVA

SEQ ID NO: 8868 - protein, 7 aa, Artificial Sequence
  Description of Artificial Sequence: Synthetic peptide
  XENP018783 vlCDR2
YASHRYT

SEQ ID NO: 8869 - protein, 9 aa, Artificial Sequence
  Description of Artificial Sequence: Synthetic peptide
  XENP018783 vlCDR3
QQDYSSPRT

SEQ ID NO: 8870 - protein, 249 aa, Artificial Sequence
  Description of Artificial Sequence: Synthetic polypeptide
  XENP018784 1G6_H1_L1.42_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNRVAWYQQKPGQSPRLLINYASHRYTGVPDRFTGSGYGTEFTLTISSLQSEDFAVYFCQQDYSSPRTFGGGTKVEIK

SEQ ID NO: 8871 - protein, 122 aa, Artificial Sequence; identical to SEQ ID NO: 6246
  Description of Artificial Sequence: Synthetic polypeptide
  VH of XENP018784

SEQ ID NO: 8872 - protein, 107 aa, Artificial Sequence
  Description of Artificial Sequence: Synthetic polypeptide
  VL of XENP018784
SIVMTQSPATLSVSPGERATLSCRASQSVSNRVAWYQQKPGQSPRLLINYASHRYTGVPDRFTGSGYGTEFTLTISSLQSEDFAVYFCQQDYSSPRTFGGGTKVEIK

SEQ ID NO: 8873 - protein, 5 aa, Artificial Sequence
  Description of Artificial Sequence: Synthetic peptide
  XENP018784 vhCDR1
NYWMN

SEQ ID NO: 8874 - protein, 19 aa, Artificial Sequence
  Description of Artificial Sequence: Synthetic peptide
  XENP018784 vhCDR2
EIRLKSNNYATHYAEPVKG

SEQ ID NO: 8875 - protein, 11 aa, Artificial Sequence
  Description of Artificial Sequence: Synthetic peptide
  XENP018784 vhCDR3
YYGNYGGYFDV

SEQ ID NO: 8876 - protein, 11 aa, Artificial Sequence
  Description of Artificial Sequence: Synthetic peptide
  XENP018784 vlCDR1
RASQSVSNRVA

SEQ ID NO: 8877 - protein, 7 aa, Artificial Sequence
  Description of Artificial Sequence: Synthetic peptide
  XENP018784 vlCDR2
YASHRYT

SEQ ID NO: 8878 - protein, 9 aa, Artificial Sequence
  Description of Artificial Sequence: Synthetic peptide
  XENP018784 vlCDR3
QQDYSSPRT

SEQ ID NO: 8879 - protein, 249 aa, Artificial Sequence
  Description of Artificial Sequence: Synthetic polypeptide
  XENP018785 1G6_H1_L1.43_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNLVAWYQQKPGQSPRLLINYASHRYTGVPDRFTGSGYGTEFTLTISSLQSEDFAVYFCQQDYSSPRTFGGGTKVEIK

SEQ ID NO: 8880 - protein, 122 aa, Artificial Sequence; identical to SEQ ID NO: 6246
  Description of Artificial Sequence: Synthetic polypeptide
  VH of XENP018785

SEQ ID NO: 8881 - protein, 107 aa, Artificial Sequence
  Description of Artificial Sequence: Synthetic polypeptide
  VL of XENP018785
SIVMTQSPATLSVSPGERATLSCRASQSVSNLVAWYQQKPGQSPRLLINYASHRYTGVPDRFTGSGYGTEFTLTISSLQSEDFAVYFCQQDYSSPRTFGGGTKVEIK

SEQ ID NO: 8882 - protein, 5 aa, Artificial Sequence
  Description of Artificial Sequence: Synthetic peptide
  XENP018785 vhCDR1
NYWMN

SEQ ID NO: 8883 - protein, 19 aa, Artificial Sequence
  Description of Artificial Sequence: Synthetic peptide
  XENP018785 vhCDR2
EIRLKSNNYATHYAEPVKG

SEQ ID NO: 8884 - protein, 11 aa, Artificial Sequence
  Description of Artificial Sequence: Synthetic peptide
  XENP018785 vhCDR3
YYGNYGGYFDV

SEQ ID NO: 8885 - protein, 11 aa, Artificial Sequence
  Description of Artificial Sequence: Synthetic peptide
  XENP018785 vlCDR1
RASQSVSNLVA

SEQ ID NO: 8886 - protein, 7 aa, Artificial Sequence
  Description of Artificial Sequence: Synthetic peptide
  XENP018785 vlCDR2
YASHRYT

SEQ ID NO: 8887 - protein, 9 aa, Artificial Sequence
  Description of Artificial Sequence: Synthetic peptide
  XENP018785 vlCDR3
QQDYSSPRT

SEQ ID NO: 8888 - protein, 249 aa, Artificial Sequence
  Description of Artificial Sequence: Synthetic polypeptide
  XENP018786 1G6_H1_L1.44_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNTVAWYQQKPGQSPRLLINYASHRYTGVPDRFTGSGYGTEFTLTISSLQSEDFAVYFCQQDYSSPRTFGGGTKVEIK

SEQ ID NO: 8889 - protein, 122 aa, Artificial Sequence; identical to SEQ ID NO: 6246
  Description of Artificial Sequence: Synthetic polypeptide
  VH of XENP018786

SEQ ID NO: 8890 - protein, 107 aa, Artificial Sequence
  Description of Artificial Sequence: Synthetic polypeptide
  VL of XENP018786
SIVMTQSPATLSVSPGERATLSCRASQSVSNTVAWYQQKPGQSPRLLINYASHRYTGVPDRFTGSGYGTEFTLTISSLQSEDFAVYFCQQDYSSPRTFGGGTKVEIK

SEQ ID NO: 8891 - protein, 5 aa, Artificial Sequence
  Description of Artificial Sequence: Synthetic peptide
  XENP018786 vhCDR1
NYWMN

SEQ ID NO: 8892 - protein, 19 aa, Artificial Sequence
  Description of Artificial Sequence: Synthetic peptide
  XENP018786 vhCDR2
EIRLKSNNYATHYAEPVKG

SEQ ID NO: 8893 - protein, 11 aa, Artificial Sequence
  Description of Artificial Sequence: Synthetic peptide
  XENP018786 vhCDR3
YYGNYGGYFDV

SEQ ID NO: 8894 - protein, 11 aa, Artificial Sequence
  Description of Artificial Sequence: Synthetic peptide
  XENP018786 vlCDR1
RASQSVSNTVA

SEQ ID NO: 8895 - protein, 7 aa, Artificial Sequence
  Description of Artificial Sequence: Synthetic peptide
  XENP018786 vlCDR2
YASHRYT

SEQ ID NO: 8896 - protein, 9 aa, Artificial Sequence
  Description of Artificial Sequence: Synthetic peptide
  XENP018786 vlCDR3
QQDYSSPRT

SEQ ID NO: 8897 - protein, 249 aa, Artificial Sequence
  Description of Artificial Sequence: Synthetic polypeptide
  XENP018787 1G6_H1_L1.45_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNGVAWYQQKPGQSPRLLINYASHRYTGVPDRFTGSGYGTEFTLTISSLQSEDFAVYFCQQDYSSPRTFGGGTKVEIK

SEQ ID NO: 8898 - protein, 122 aa, Artificial Sequence; identical to SEQ ID NO: 6246
  Description of Artificial Sequence: Synthetic polypeptide
  VH of XENP018787

SEQ ID NO: 8899 - protein, 107 aa, Artificial Sequence
  Description of Artificial Sequence: Synthetic polypeptide
  VL of XENP018787
SIVMTQSPATLSVSPGERATLSCRASQSVSNGVAWYQQKPGQSPRLLINYASHRYTGVPDRFTGSGYGTEFTLTISSLQSEDFAVYFCQQDYSSPRTFGGGTKVEIK

SEQ ID NO: 8900 - protein, 5 aa, Artificial Sequence
  Description of Artificial Sequence: Synthetic peptide
  XENP018787 vhCDR1
NYWMN

SEQ ID NO: 8901 - protein, 19 aa, Artificial Sequence
  Description of Artificial Sequence: Synthetic peptide
  XENP018787 vhCDR2
EIRLKSNNYATHYAEPVKG

SEQ ID NO: 8902 - protein, 11 aa, Artificial Sequence
  Description of Artificial Sequence: Synthetic peptide
  XENP018787 vhCDR3
YYGNYGGYFDV

SEQ ID NO: 8903 - protein, 11 aa, Artificial Sequence
  Description of Artificial Sequence: Synthetic peptide
  XENP018787 vlCDR1
RASQSVSNGVA

SEQ ID NO: 8904 - protein, 7 aa, Artificial Sequence
  Description of Artificial Sequence: Synthetic peptide
  XENP018787 vlCDR2
YASHRYT

SEQ ID NO: 8905 - protein, 9 aa, Artificial Sequence
  Description of Artificial Sequence: Synthetic peptide
  XENP018787 vlCDR3
QQDYSSPRT

SEQ ID NO: 8906 - protein, 249 aa, Artificial Sequence
  Description of Artificial Sequence: Synthetic polypeptide
  XENP018788 1G6_H1_L1.46_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNYVAWYQQKPGQSPRLLINYASHRYTGVPDRFTGSGYGTEFTLTISSLQSEDFAVYFCQQDYSSPRTFGGGTKVEIK

SEQ ID NO: 8907 - protein, 122 aa, Artificial Sequence; identical to SEQ ID NO: 6246
  Description of Artificial Sequence: Synthetic polypeptide
  VH of XENP018788

SEQ ID NO: 8908 - protein, 107 aa, Artificial Sequence
  Description of Artificial Sequence: Synthetic polypeptide
  VL of XENP018788
SIVMTQSPATLSVSPGERATLSCRASQSVSNYVAWYQQKPGQSPRLLINYASHRYTGVPDRFTGSGYGTEFTLTISSLQSEDFAVYFCQQDYSSPRTFGGGTKVEIK

SEQ ID NO: 8909 - protein, 5 aa, Artificial Sequence
  Description of Artificial Sequence: Synthetic peptide
  XENP018788 vhCDR1
NYWMN

SEQ ID NO: 8910 - protein, 19 aa, Artificial Sequence
  Description of Artificial Sequence: Synthetic peptide
  XENP018788 vhCDR2
EIRLKSNNYATHYAEPVKG

SEQ ID NO: 8911 - protein, 11 aa, Artificial Sequence
  Description of Artificial Sequence: Synthetic peptide
  XENP018788 vhCDR3
YYGNYGGYFDV

SEQ ID NO: 8912 - protein, 11 aa, Artificial Sequence
  Description of Artificial Sequence: Synthetic peptide
  XENP018788 vlCDR1
RASQSVSNYVA

SEQ ID NO: 8913 - protein, 7 aa, Artificial Sequence
  Description of Artificial Sequence: Synthetic peptide
  XENP018788 vlCDR2
YASHRYT

SEQ ID NO: 8914 - protein, 9 aa, Artificial Sequence
  Description of Artificial Sequence: Synthetic peptide
  XENP018788 vlCDR3
QQDYSSPRT

SEQ ID NO: 8915 - protein, 249 aa, Artificial Sequence
  Description of Artificial Sequence: Synthetic polypeptide
  XENP018789 1G6_H1_L1.47_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDLAWYQQKPGQSPRLLINYASHRYTGVPDRFTGSGYGTEFTLTISSLQSEDFAVYFCQQDYSSPRTFGGGTKVEIK

SEQ ID NO: 8916 - protein, 122 aa, Artificial Sequence; identical to SEQ ID NO: 6246
  Description of Artificial Sequence: Synthetic polypeptide
  VH of XENP018789

SEQ ID NO: 8917 - protein, 107 aa, Artificial Sequence
  Description of Artificial Sequence: Synthetic polypeptide
  VL of XENP018789
SIVMTQSPATLSVSPGERATLSCRASQSVSNDLAWYQQKPGQSPRLLINYASHRYTGVPDRFTGSGYGTEFTLTISSLQSEDFAVYFCQQDYSSPRTFGGGTKVEIK

SEQ ID NO: 8918 - protein, 5 aa, Artificial Sequence
  Description of Artificial Sequence: Synthetic peptide
  XENP018789 vhCDR1
NYWMN

SEQ ID NO: 8919 - protein, 19 aa, Artificial Sequence
  Description of Artificial Sequence: Synthetic peptide
  XENP018789 vhCDR2
EIRLKSNNYATHYAEPVKG

SEQ ID NO: 8920 - protein, 11 aa, Artificial Sequence
  Description of Artificial Sequence: Synthetic peptide
  XENP018789 vhCDR3
YYGNYGGYFDV

SEQ ID NO: 8921 - protein, 11 aa, Artificial Sequence
  Description of Artificial Sequence: Synthetic peptide
  XENP018789 vlCDR1
RASQSVSNDLA

SEQ ID NO: 8922 - protein, 7 aa, Artificial Sequence
  Description of Artificial Sequence: Synthetic peptide
  XENP018789 vlCDR2
YASHRYT

SEQ ID NO: 8923 - protein, 9 aa, Artificial Sequence
  Description of Artificial Sequence: Synthetic peptide
  XENP018789 vlCDR3
QQDYSSPRT

SEQ ID NO: 8924 - protein, 249 aa, Artificial Sequence
  Description of Artificial Sequence: Synthetic polypeptide
  XENP018790 1G6_H1_L1.48_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVSWYQQKPGQSPRLLINYASHRYTGVPDRFTGSGYGTEFTLTISSLQSEDFAVYFCQQDYSSPRTFGGGTKVEIK

SEQ ID NO: 8925 - protein, 122 aa, Artificial Sequence; identical to SEQ ID NO: 6246
  Description of Artificial Sequence: Synthetic polypeptide
  VH of XENP018790

SEQ ID NO: 8926 - protein, 107 aa, Artificial Sequence
  Description of Artificial Sequence: Synthetic polypeptide
  VL of XENP018790
SIVMTQSPATLSVSPGERATLSCRASQSVSNDVSWYQQKPGQSPRLLINYASHRYTGVPDRFTGSGYGTEFTLTISSLQSEDFAVYFCQQDYSSPRTFGGGTKVEIK

SEQ ID NO: 8927 - protein, 5 aa, Artificial Sequence
  Description of Artificial Sequence: Synthetic peptide
  XENP018790 vhCDR1
NYWMN

SEQ ID NO: 8928 - protein, 19 aa, Artificial Sequence
  Description of Artificial Sequence: Synthetic peptide
  XENP018790 vhCDR2
EIRLKSNNYATHYAEPVKG

SEQ ID NO: 8929 - protein, 11 aa, Artificial Sequence
  Description of Artificial Sequence: Synthetic peptide
  XENP018790 vhCDR3
YYGNYGGYFDV

SEQ ID NO: 8930 - protein, 11 aa, Artificial Sequence
  Description of Artificial Sequence: Synthetic peptide
  XENP018790 vlCDR1
RASQSVSNDVS

SEQ ID NO: 8931 - protein, 7 aa, Artificial Sequence
  Description of Artificial Sequence: Synthetic peptide
  XENP018790 vlCDR2
YASHRYT

SEQ ID NO: 8932 - protein, 9 aa, Artificial Sequence
  Description of Artificial Sequence: Synthetic peptide
  XENP018790 vlCDR3
QQDYSSPRT

SEQ ID NO: 8933 - protein, 249 aa, Artificial Sequence
  Description of Artificial Sequence: Synthetic polypeptide
  XENP018791 1G6_H1_L1.49_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVTWYQQKPGQSPRLLINYASHRYTGVPDRFTGSGYGTEFTLTISSLQSEDFAVYFCQQDYSSPRTFGGGTKVEIK

SEQ ID NO: 8934 - protein, 122 aa, Artificial Sequence; identical to SEQ ID NO: 6246
  Description of Artificial Sequence: Synthetic polypeptide
  VH of XENP018791

SEQ ID NO: 8935 - protein, 107 aa, Artificial Sequence
  Description of Artificial Sequence: Synthetic polypeptide
  VL of XENP018791
SIVMTQSPATLSVSPGERATLSCRASQSVSNDVTWYQQKPGQSPRLLINYASHRYTGVPDRFTGSGYGTEFTLTISSLQSEDFAVYFCQQDYSSPRTFGGGTKVEIK

SEQ ID NO: 8936 - protein, 5 aa, Artificial Sequence
  Description of Artificial Sequence: Synthetic peptide
  XENP018791 vhCDR1
NYWMN

SEQ ID NO: 8937 - protein, 19 aa, Artificial Sequence
  Description of Artificial Sequence: Synthetic peptide
  XENP018791 vhCDR2
EIRLKSNNYATHYAEPVKG

SEQ ID NO: 8938 - protein, 11 aa, Artificial Sequence
  Description of Artificial Sequence: Synthetic peptide
  XENP018791 vhCDR3
YYGNYGGYFDV

SEQ ID NO: 8939 - protein, 11 aa, Artificial Sequence
  Description of Artificial Sequence: Synthetic peptide
  XENP018791 vlCDR1
RASQSVSNDVT

SEQ ID NO: 8940 - protein, 7 aa, Artificial Sequence
  Description of Artificial Sequence: Synthetic peptide
  XENP018791 vlCDR2
YASHRYT

SEQ ID NO: 8941 - protein, 9 aa, Artificial Sequence
  Description of Artificial Sequence: Synthetic peptide
  XENP018791 vlCDR3
QQDYSSPRT

SEQ ID NO: 8942 - protein, 249 aa, Artificial Sequence
  Description of Artificial Sequence: Synthetic polypeptide
  XENP018792 1G6_H1_L1.50_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQAPRLLINYASHRYTGVPDRFTGSGYGTEFTLTISSLQSEDFAVYFCQQDYSSPRTFGGGTKVEIK

SEQ ID NO: 8943 - protein, 122 aa, Artificial Sequence; identical to SEQ ID NO: 6246
  Description of Artificial Sequence: Synthetic polypeptide
  VH of XENP018792

SEQ ID NO: 8944 - protein, 107 aa, Artificial Sequence
  Description of Artificial Sequence: Synthetic polypeptide
  VL of XENP018792
SIVMTQSPATLSVSPGERATLSCRASQSVSNDVAWYQQKPGQAPRLLINYASHRYTGVPDRFTGSGYGTEFTLTISSLQSEDFAVYFCQQDYSSPRTFGGGTKVEIK

SEQ ID NO: 8945 - protein, 5 aa, Artificial Sequence
  Description of Artificial Sequence: Synthetic peptide
  XENP018792 vhCDR1
NYWMN

SEQ ID NO: 8946 - protein, 19 aa, Artificial Sequence
  Description of Artificial Sequence: Synthetic peptide
  XENP018792 vhCDR2
EIRLKSNNYATHYAEPVKG

SEQ ID NO: 8947 - protein, 11 aa, Artificial Sequence
  Description of Artificial Sequence: Synthetic peptide
  XENP018792 vhCDR3
YYGNYGGYFDV

SEQ ID NO: 8948 - protein, 11 aa, Artificial Sequence
  Description of Artificial Sequence: Synthetic peptide
  XENP018792 vlCDR1
RASQSVSNDVA

SEQ ID NO: 8949 - protein, 7 aa, Artificial Sequence
  Description of Artificial Sequence: Synthetic peptide
  XENP018792 vlCDR2
YASHRYT

SEQ ID NO: 8950 - protein, 9 aa, Artificial Sequence
  Description of Artificial Sequence: Synthetic peptide
  XENP018792 vlCDR3
QQDYSSPRT

SEQ ID NO: 8951 - protein, 249 aa, Artificial Sequence
  Description of Artificial Sequence: Synthetic polypeptide
  XENP018793 1G6_H1_L1.51_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPKLLINYASHRYTGVPDRFTGSGYGTEFTLTISSLQSEDFAVYFCQQDYSSPRTFGGGTKVEIK

SEQ ID NO: 8952 - protein, 122 aa, Artificial Sequence; identical to SEQ ID NO: 6246
  Description of Artificial Sequence: Synthetic polypeptide
  VH of XENP018793

SEQ ID NO: 8953 - protein, 107 aa, Artificial Sequence
  Description of Artificial Sequence: Synthetic polypeptide
  VL of XENP018793
SIVMTQSPATLSVSPGERATLSCRASQSVSNDVAWYQQKPGQSPKLLINYASHRYTGVPDRFTGSGYGTEFTLTISSLQSEDFAVYFCQQDYSSPRTFGGGTKVEIK

SEQ ID NO: 8954 - protein, 5 aa, Artificial Sequence
  Description of Artificial Sequence: Synthetic peptide
  XENP018793 vhCDR1
NYWMN

SEQ ID NO: 8955 - protein, 19 aa, Artificial Sequence
  Description of Artificial Sequence: Synthetic peptide
  XENP018793 vhCDR2
EIRLKSNNYATHYAEPVKG

SEQ ID NO: 8956 - protein, 11 aa, Artificial Sequence
  Description of Artificial Sequence: Synthetic peptide
  XENP018793 vhCDR3
YYGNYGGYFDV

SEQ ID NO: 8957 - protein, 11 aa, Artificial Sequence
  Description of Artificial Sequence: Synthetic peptide
  XENP018793 vlCDR1
RASQSVSNDVA

SEQ ID NO: 8958 - protein, 7 aa, Artificial Sequence
  Description of Artificial Sequence: Synthetic peptide
  XENP018793 vlCDR2
YASHRYT

SEQ ID NO: 8959 - protein, 9 aa, Artificial Sequence
  Description of Artificial Sequence: Synthetic peptide
  XENP018793 vlCDR3
QQDYSSPRT

SEQ ID NO: 8960 - protein, 249 aa, Artificial Sequence
  Description of Artificial Sequence: Synthetic polypeptide
  XENP018794 1G6_H1_L1.52_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPQLLINYASHRYTGVPDRFTGSGYGTEFTLTISSLQSEDFAVYFCQQDYSSPRTFGGGTKVEIK

SEQ ID NO: 8961 - protein, 122 aa, Artificial Sequence; identical to SEQ ID NO: 6246
  Description of Artificial Sequence: Synthetic polypeptide
  VH of XENP018794

SEQ ID NO: 8962 - protein, 107 aa, Artificial Sequence
  Description of Artificial Sequence: Synthetic polypeptide
  VL of XENP018794
SIVMTQSPATLSVSPGERATLSCRASQSVSNDVAWYQQKPGQSPQLLINYASHRYTGVPDRFTGSGYGTEFTLTISSLQSEDFAVYFCQQDYSSPRTFGGGTKVEIK

SEQ ID NO: 8963 - protein, 5 aa, Artificial Sequence
  Description of Artificial Sequence: Synthetic peptide
  XENP018794 vhCDR1
NYWMN

SEQ ID NO: 8964 - protein, 19 aa, Artificial Sequence
  Description of Artificial Sequence: Synthetic peptide
  XENP018794 vhCDR2
EIRLKSNNYATHYAEPVKG

SEQ ID NO: 8965 - protein, 11 aa, Artificial Sequence
  Description of Artificial Sequence: Synthetic peptide
  XENP018794 vhCDR3
YYGNYGGYFDV

SEQ ID NO: 8966 - protein, 11 aa, Artificial Sequence
  Description of Artificial Sequence: Synthetic peptide
  XENP018794 vlCDR1
RASQSVSNDVA

SEQ ID NO: 8967 - protein, 7 aa, Artificial Sequence
  Description of Artificial Sequence: Synthetic peptide
  XENP018794 vlCDR2
YASHRYT

SEQ ID NO: 8968 - protein, 9 aa, Artificial Sequence
  Description of Artificial Sequence: Synthetic peptide
  XENP018794 vlCDR3
QQDYSSPRT

SEQ ID NO: 8969 - protein, 249 aa, Artificial Sequence
  Description of Artificial Sequence: Synthetic polypeptide
  XENP018795 1G6_H1_L1.53_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPILLINYASHRYTGVPDRFTGSGYGTEFTLTISSLQSEDFAVYFCQQDYSSPRTFGGGTKVEIK

SEQ ID NO: 8970 - protein, 122 aa, Artificial Sequence; identical to SEQ ID NO: 6246
  Description of Artificial Sequence: Synthetic polypeptide
  VH of XENP018795

SEQ ID NO: 8971 - protein, 107 aa, Artificial Sequence
  Description of Artificial Sequence: Synthetic polypeptide
  VL of XENP018795
SIVMTQSPATLSVSPGERATLSCRASQSVSNDVAWYQQKPGQSPILLINYASHRYTGVPDRFTGSGYGTEFTLTISSLQSEDFAVYFCQQDYSSPRTFGGGTKVEIK

SEQ ID NO: 8972 - protein, 5 aa, Artificial Sequence
  Description of Artificial Sequence: Synthetic peptide
  XENP018795 vhCDR1
NYWMN

SEQ ID NO: 8973 - protein, 19 aa, Artificial Sequence
  Description of Artificial Sequence: Synthetic peptide
  XENP018795 vhCDR2
EIRLKSNNYATHYAEPVKG

SEQ ID NO: 8974 - protein, 11 aa, Artificial Sequence
  Description of Artificial Sequence: Synthetic peptide
  XENP018795 vhCDR3
YYGNYGGYFDV

SEQ ID NO: 8975 - protein, 11 aa, Artificial Sequence
  Description of Artificial Sequence: Synthetic peptide
  XENP018795 vlCDR1
RASQSVSNDVA

SEQ ID NO: 8976 - protein, 7 aa, Artificial Sequence
  Description of Artificial Sequence: Synthetic peptide
  XENP018795 vlCDR2
YASHRYT

SEQ ID NO: 8977 - protein, 9 aa, Artificial Sequence
  Description of Artificial Sequence: Synthetic peptide
  XENP018795 vlCDR3
QQDYSSPRT

SEQ ID NO: 8978 - protein, 249 aa, Artificial Sequence
  Description of Artificial Sequence: Synthetic polypeptide
  XENP018796 1G6_H1_L1.54_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLIYYASHRYTGVPDRFTGSGYGTEFTLTISSLQSEDFAVYFCQQDYSSPRTFGGGTKVEIK

SEQ ID NO: 8979 - protein, 122 aa, Artificial Sequence; identical to SEQ ID NO: 6246
  Description of Artificial Sequence: Synthetic polypeptide
  VH of XENP018796

SEQ ID NO: 8980 - protein, 107 aa, Artificial Sequence
  Description of Artificial Sequence: Synthetic polypeptide
  VL of XENP018796
SIVMTQSPATLSVSPGERATLSCRASQSVSNDVAWYQQKPGQSPRLLIYYASHRYTGVPDRFTGSGYGTEFTLTISSLQSEDFAVYFCQQDYSSPRTFGGGTKVEIK

SEQ ID NO: 8981 - protein, 5 aa, Artificial Sequence
  Description of Artificial Sequence: Synthetic peptide
  XENP018796 vhCDR1
NYWMN

SEQ ID NO: 8982 - protein, 19 aa, Artificial Sequence
  Description of Artificial Sequence: Synthetic peptide
  XENP018796 vhCDR2
EIRLKSNNYATHYAEPVKG

SEQ ID NO: 8983 - protein, 11 aa, Artificial Sequence
  Description of Artificial Sequence: Synthetic peptide
  XENP018796 vhCDR3
YYGNYGGYFDV

SEQ ID NO: 8984 - protein, 11 aa, Artificial Sequence
  Description of Artificial Sequence: Synthetic peptide
  XENP018796 vlCDR1
RASQSVSNDVA

SEQ ID NO: 8985 - protein, 7 aa, Artificial Sequence
  Description of Artificial Sequence: Synthetic peptide
  XENP018796 vlCDR2
YASHRYT

SEQ ID NO: 8986 - protein, 9 aa, Artificial Sequence
  Description of Artificial Sequence: Synthetic peptide
  XENP018796 vlCDR3
QQDYSSPRT

SEQ ID NO: 8987 - protein, 249 aa, Artificial Sequence
  Description of Artificial Sequence: Synthetic polypeptide
  XENP018801 1G6_H1_L1.55_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINFASHRYTGVPDRFTGSGYGTEFTLTISSLQSEDFAVYFCQQDYSSPRTFGGGTKVEIK

SEQ ID NO: 8988 - protein, 122 aa, Artificial Sequence; identical to SEQ ID NO: 6246
  Description of Artificial Sequence: Synthetic polypeptide
  VH of XENP018801

SEQ ID NO: 8989 - protein, 107 aa, Artificial Sequence
  Description of Artificial Sequence: Synthetic polypeptide
  VL of XENP018801
SIVMTQSPATLSVSPGERATLSCRASQSVSNDVAWYQQKPGQSPRLLINFASHRYTGVPDRFTGSGYGTEFTLTISSLQSEDFAVYFCQQDYSSPRTFGGGTKVEIK

SEQ ID NO: 8990 - protein, 5 aa, Artificial Sequence
  Description of Artificial Sequence: Synthetic peptide
  XENP018801 vhCDR1
NYWMN

SEQ ID NO: 8991 - protein, 19 aa, Artificial Sequence
  Description of Artificial Sequence: Synthetic peptide
  XENP018801 vhCDR2
EIRLKSNNYATHYAEPVKG

SEQ ID NO: 8992 - protein, 11 aa, Artificial Sequence
  Description of Artificial Sequence: Synthetic peptide
  XENP018801 vhCDR3
YYGNYGGYFDV

SEQ ID NO: 8993 - protein, 11 aa, Artificial Sequence
  Description of Artificial Sequence: Synthetic peptide
  XENP018801 vlCDR1
RASQSVSNDVA

SEQ ID NO: 8994 - protein, 7 aa, Artificial Sequence
  Description of Artificial Sequence: Synthetic peptide
  XENP018801 vlCDR2
FASHRYT

SEQ ID NO: 8995 - protein, 9 aa, Artificial Sequence
  Description of Artificial Sequence: Synthetic peptide
  XENP018801 vlCDR3
QQDYSSPRT

SEQ ID NO: 8996 - protein, 249 aa, Artificial Sequence
  Description of Artificial Sequence: Synthetic polypeptide
  XENP018802 1G6_H1_L1.56_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINHASHRYTGVPDRFTGSGYGTEFTLTISSLQSEDFAVYFCQQDYSSPRTFGGGTKVEIK

SEQ ID NO: 8997 - protein, 122 aa, Artificial Sequence; identical to SEQ ID NO: 6246
  Description of Artificial Sequence: Synthetic polypeptide
  VH of XENP018802

SEQ ID NO: 8998 - protein, 107 aa, Artificial Sequence
  Description of Artificial Sequence: Synthetic polypeptide
  VL of XENP018802
SIVMTQSPATLSVSPGERATLSCRASQSVSNDVAWYQQKPGQSPRLLINHASHRYTGVPDRFTGSGYGTEFTLTISSLQSEDFAVYFCQQDYSSPRTFGGGTKVEIK

SEQ ID NO: 8999 - protein, 5 aa, Artificial Sequence
  Description of Artificial Sequence: Synthetic peptide
  XENP018802 vhCDR1
NYWMN

SEQ ID NO: 9000 - protein, 19 aa, Artificial Sequence
  Description of Artificial Sequence: Synthetic peptide
  XENP018802 vhCDR2
EIRLKSNNYATHYAEPVKG

SEQ ID NO: 9001 - protein, 11 aa, Artificial Sequence
  Description of Artificial Sequence: Synthetic peptide
  XENP018802 vhCDR3
YYGNYGGYFDV

SEQ ID NO: 9002 - protein, 11 aa, Artificial Sequence
  Description of Artificial Sequence: Synthetic peptide
  XENP018802 vlCDR1
RASQSVSNDVA

SEQ ID NO: 9003 - protein, 7 aa, Artificial Sequence
  Description of Artificial Sequence: Synthetic peptide
  XENP018802 vlCDR2
HASHRYT

SEQ ID NO: 9004 - protein, 9 aa, Artificial Sequence
  Description of Artificial Sequence: Synthetic peptide
  XENP018802 vlCDR3
QQDYSSPRT

SEQ ID NO: 9005 - protein, 249 aa, Artificial Sequence
  Description of Artificial Sequence: Synthetic polypeptide
  XENP018803 1G6_H1_L1.57_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINLASHRYTGVPDRFTGSGYGTEFTLTISSLQSEDFAVYFCQQDYSSPRTFGGGTKVEIK

SEQ ID NO: 9006 - protein, 122 aa, Artificial Sequence; identical to SEQ ID NO: 6246
  Description of Artificial Sequence: Synthetic polypeptide
  VH of XENP018803

SEQ ID NO: 9007 - protein, 107 aa, Artificial Sequence
  Description of Artificial Sequence: Synthetic polypeptide
  VL of XENP018803
SIVMTQSPATLSVSPGERATLSCRASQSVSNDVAWYQQKPGQSPRLLINLASHRYTGVPDRFTGSGYGTEFTLTISSLQSEDFAVYFCQQDYSSPRTFGGGTKVEIK

SEQ ID NO: 9008 - protein, 5 aa, Artificial Sequence
  Description of Artificial Sequence: Synthetic peptide
  XENP018803 vhCDR1
NYWMN

SEQ ID NO: 9009 - protein, 19 aa, Artificial Sequence
  Description of Artificial Sequence: Synthetic peptide
  XENP018803 vhCDR2
EIRLKSNNYATHYAEPVKG

SEQ ID NO: 9010 - protein, 11 aa, Artificial Sequence
  Description of Artificial Sequence: Synthetic peptide
  XENP018803 vhCDR3
YYGNYGGYFDV

SEQ ID NO: 9011 - protein, 11 aa, Artificial Sequence
  Description of Artificial Sequence: Synthetic peptide
  XENP018803 vlCDR1
RASQSVSNDVA

SEQ ID NO: 9012 - protein, 7 aa, Artificial Sequence
  Description of Artificial Sequence: Synthetic peptide
  XENP018803 vlCDR2
LASHRYT

SEQ ID NO: 9013 - protein, 9 aa, Artificial Sequence
  Description of Artificial Sequence: Synthetic peptide
  XENP018803 vlCDR3
QQDYSSPRT

SEQ ID NO: 9014 - protein, 249 aa, Artificial Sequence
  Description of Artificial Sequence: Synthetic polypeptide
  XENP018804 1G6_H1_L1.58_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINWASHRYTGVPDRFTGSGYGTEFTLTISSLQSEDFAVYFCQQDYSSPRTFGGGTKVEIK

SEQ ID NO: 9015 - protein, 122 aa, Artificial Sequence; identical to SEQ ID NO: 6246
  Description of Artificial Sequence: Synthetic polypeptide
  VH of XENP018804

SEQ ID NO: 9016 - protein, 107 aa, Artificial Sequence
  Description of Artificial Sequence: Synthetic polypeptide
  VL of XENP018804
SIVMTQSPATLSVSPGERATLSCRASQSVSNDVAWYQQKPGQSPRLLINWASHRYTGVPDRFTGSGYGTEFTLTISSLQSEDFAVYFCQQDYSSPRTFGGGTKVEIK

SEQ ID NO: 9017 - protein, 5 aa, Artificial Sequence
  Description of Artificial Sequence: Synthetic peptide
  XENP018804 vhCDR1
NYWMN

SEQ ID NO: 9018 - protein, 19 aa, Artificial Sequence
  Description of Artificial Sequence: Synthetic peptide
  XENP018804 vhCDR2
EIRLKSNNYATHYAEPVKG

SEQ ID NO: 9019 - protein, 11 aa, Artificial Sequence
  Description of Artificial Sequence: Synthetic peptide
  XENP018804 vhCDR3
YYGNYGGYFDV

SEQ ID NO: 9020 - protein, 11 aa, Artificial Sequence
  Description of Artificial Sequence: Synthetic peptide
  XENP018804 vlCDR1
RASQSVSNDVA

SEQ ID NO: 9021 - protein, 7 aa, Artificial Sequence
  Description of Artificial Sequence: Synthetic peptide
  XENP018804 vlCDR2
WASHRYT

SEQ ID NO: 9022 - protein, 9 aa, Artificial Sequence
  Description of Artificial Sequence: Synthetic peptide
  XENP018804 vlCDR3
QQDYSSPRT

SEQ ID NO: 9023 - protein, 249 aa, Artificial Sequence
  Description of Artificial Sequence: Synthetic polypeptide
  XENP018805 1G6_H1_L1.59_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINVASHRYTGVPDRFTGSGYGTEFTLTISSLQSEDFAVYFCQQDYSSPRTFGGGTKVEIK

SEQ ID NO: 9024 - protein, 122 aa, Artificial Sequence; identical to SEQ ID NO: 6246
  Description of Artificial Sequence: Synthetic polypeptide
  VH of XENP018805

SEQ ID NO: 9025 - protein, 107 aa, Artificial Sequence
  Description of Artificial Sequence: Synthetic polypeptide
  VL of XENP018805
SIVMTQSPATLSVSPGERATLSCRASQSVSNDVAWYQQKPGQSPRLLINVASHRYTGVPDRFTGSGYGTEFTLTISSLQSEDFAVYFCQQDYSSPRTFGGGTKVEIK

SEQ ID NO: 9026 - protein, 5 aa, Artificial Sequence
  Description of Artificial Sequence: Synthetic peptide
  XENP018805 vhCDR1
NYWMN

SEQ ID NO: 9027 - protein, 19 aa, Artificial Sequence
  Description of Artificial Sequence: Synthetic peptide
  XENP018805 vhCDR2
EIRLKSNNYATHYAEPVKG

SEQ ID NO: 9028 - protein, 11 aa, Artificial Sequence
  Description of Artificial Sequence: Synthetic peptide
  XENP018805 vhCDR3
YYGNYGGYFDV

SEQ ID NO: 9029 - protein, 11 aa, Artificial Sequence
  Description of Artificial Sequence: Synthetic peptide
  XENP018805 vlCDR1
RASQSVSNDVA

SEQ ID NO: 9030 - protein, 7 aa, Artificial Sequence
  Description of Artificial Sequence: Synthetic peptide
  XENP018805 vlCDR2
VASHRYT

SEQ ID NO: 9031 - protein, 9 aa, Artificial Sequence
  Description of Artificial Sequence: Synthetic peptide
  XENP018805 vlCDR3
QQDYSSPRT

SEQ ID NO: 9032 - protein, 249 aa, Artificial Sequence
  Description of Artificial Sequence: Synthetic polypeptide
  XENP018806 1G6_H1_L1.60_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINAASHRYTGVPDRFTGSGYGTEFTLTISSLQSEDFAVYFCQQDYSSPRTFGGGTKVEIK

SEQ ID NO: 9033 - protein, 122 aa, Artificial Sequence; identical to SEQ ID NO: 6246
  Description of Artificial Sequence: Synthetic polypeptide
  VH of XENP018806

SEQ ID NO: 9034 - protein, 107 aa, Artificial Sequence
  Description of Artificial Sequence: Synthetic polypeptide
  VL of XENP018806
SIVMTQSPATLSVSPGERATLSCRASQSVSNDVAWYQQKPGQSPRLLINAASHRYTGVPDRFTGSGYGTEFTLTISSLQSEDFAVYFCQQDYSSPRTFGGGTKVEIK

SEQ ID NO: 9035 - protein, 5 aa, Artificial Sequence
  Description of Artificial Sequence: Synthetic peptide
  XENP018806 vhCDR1
NYWMN

SEQ ID NO: 9036 - protein, 19 aa, Artificial Sequence
  Description of Artificial Sequence: Synthetic peptide
  XENP018806 vhCDR2
EIRLKSNNYATHYAEPVKG

SEQ ID NO: 9037 - protein, 11 aa, Artificial Sequence
  Description of Artificial Sequence: Synthetic peptide
  XENP018806 vhCDR3
YYGNYGGYFDV

SEQ ID NO: 9038 - protein, 11 aa, Artificial Sequence
  Description of Artificial Sequence: Synthetic peptide
  XENP018806 vlCDR1
RASQSVSNDVA

SEQ ID NO: 9039 - protein, 7 aa, Artificial Sequence
  Description of Artificial Sequence: Synthetic peptide
  XENP018806 vlCDR2
AASHRYT

SEQ ID NO: 9040 - protein, 9 aa, Artificial Sequence
  Description of Artificial Sequence: Synthetic peptide
  XENP018806 vlCDR3
QQDYSSPRT

SEQ ID NO: 9041 - protein, 249 aa, Artificial Sequence
  Description of Artificial Sequence: Synthetic polypeptide
  XENP018807 1G6_H1_L1.61_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINQASHRYTGVPDRFTGSGYGTEFTLTISSLQSEDFAVYFCQQDYSSPRTFGGGTKVEIK

SEQ ID NO: 9042 - protein, 122 aa, Artificial Sequence; identical to SEQ ID NO: 6246
  Description of Artificial Sequence: Synthetic polypeptide
  VH of XENP018807

SEQ ID NO: 9043 - protein, 107 aa, Artificial Sequence
  Description of Artificial Sequence: Synthetic polypeptide
  VL of XENP018807
SIVMTQSPATLSVSPGERATLSCRASQSVSNDVAWYQQKPGQSPRLLINQASHRYTGVPDRFTGSGYGTEFTLTISSLQSEDFAVYFCQQDYSSPRTFGGGTKVEIK

SEQ ID NO: 9044 - protein, 5 aa, Artificial Sequence
  Description of Artificial Sequence: Synthetic peptide
  XENP018807 vhCDR1
NYWMN

SEQ ID NO: 9045 - protein, 19 aa, Artificial Sequence
  Description of Artificial Sequence: Synthetic peptide
  XENP018807 vhCDR2
EIRLKSNNYATHYAEPVKG

SEQ ID NO: 9046 - protein, 11 aa, Artificial Sequence
  Description of Artificial Sequence: Synthetic peptide
  XENP018807 vhCDR3
YYGNYGGYFDV

SEQ ID NO: 9047 - protein, 11 aa, Artificial Sequence
  Description of Artificial Sequence: Synthetic peptide
  XENP018807 vlCDR1
RASQSVSNDVA

SEQ ID NO: 9048 - protein, 7 aa, Artificial Sequence
  Description of Artificial Sequence: Synthetic peptide
  XENP018807 vlCDR2
QASHRYT

SEQ ID NO: 9049 - protein, 9 aa, Artificial Sequence
  Description of Artificial Sequence: Synthetic peptide
  XENP018807 vlCDR3
QQDYSSPRT

SEQ ID NO: 9050 - protein, 249 aa, Artificial Sequence
  Description of Artificial Sequence: Synthetic polypeptide
  XENP018808 1G6_H1_L1.62_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINDASHRYTGVPDRFTGSGYGTEFTLTISSLQSEDFAVYFCQQDYSSPRTFGGGTKVEIK

SEQ ID NO: 9051 - protein, 122 aa, Artificial Sequence; identical to SEQ ID NO: 6246
  Description of Artificial Sequence: Synthetic polypeptide
  VH of XENP018808

SEQ ID NO: 9052 - protein, 107 aa, Artificial Sequence
  Description of Artificial Sequence: Synthetic polypeptide
  VL of XENP018808
SIVMTQSPATLSVSPGERATLSCRASQSVSNDVAWYQQKPGQSPRLLINDASHRYTGVPDRFTGSGYGTEFTLTISSLQSEDFAVYFCQQDYSSPRTFGGGTKVEIK

SEQ ID NO: 9053 - protein, 5 aa, Artificial Sequence
  Description of Artificial Sequence: Synthetic peptide
  XENP018808 vhCDR1
NYWMN

SEQ ID NO: 9054 - protein, 19 aa, Artificial Sequence
  Description of Artificial Sequence: Synthetic peptide
  XENP018808 vhCDR2
EIRLKSNNYATHYAEPVKG

SEQ ID NO: 9055 - protein, 11 aa, Artificial Sequence
  Description of Artificial Sequence: Synthetic peptide
  XENP018808 vhCDR3
YYGNYGGYFDV

SEQ ID NO: 9056 - protein, 11 aa, Artificial Sequence
  Description of Artificial Sequence: Synthetic peptide
  XENP018808 vlCDR1
RASQSVSNDVA

SEQ ID NO: 9057 - protein, 7 aa, Artificial Sequence
  Description of Artificial Sequence: Synthetic peptide
  XENP018808 vlCDR2
DASHRYT

SEQ ID NO: 9058 - protein, 9 aa, Artificial Sequence
  Description of Artificial Sequence: Synthetic peptide
  XENP018808 vlCDR3
QQDYSSPRT

SEQ ID NO: 9059 - protein, 249 aa, Artificial Sequence
  Description of Artificial Sequence: Synthetic polypeptide
  XENP018809 1G6_H1_L1.63_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINKASHRYTGVPDRFTGSGYGTEFTLTISSLQSEDFAVYFCQQDYSSPRTFGGGTKVEIK

SEQ ID NO: 9060 - protein, 122 aa, Artificial Sequence; identical to SEQ ID NO: 6246
  Description of Artificial Sequence: Synthetic polypeptide
  VH of XENP018809

SEQ ID NO: 9061 - protein, 107 aa, Artificial Sequence
  Description of Artificial Sequence: Synthetic polypeptide
  VL of XENP018809
SIVMTQSPATLSVSPGERATLSCRASQSVSNDVAWYQQKPGQSPRLLINKASHRYTGVPDRFTGSGYGTEFTLTISSLQSEDFAVYFCQQDYSSPRTFGGGTKVEIK

SEQ ID NO: 9062 - protein, 5 aa, Artificial Sequence
  Description of Artificial Sequence: Synthetic peptide
  XENP018809 vhCDR1
NYWMN

SEQ ID NO: 9063 - protein, 19 aa, Artificial Sequence
  Description of Artificial Sequence: Synthetic peptide
  XENP018809 vhCDR2
EIRLKSNNYATHYAEPVKG

SEQ ID NO: 9064 - protein, 11 aa, Artificial Sequence
  Description of Artificial Sequence: Synthetic peptide
  XENP018809 vhCDR3
YYGNYGGYFDV

SEQ ID NO: 9065 - protein, 11 aa, Artificial Sequence
  Description of Artificial Sequence: Synthetic peptide
  XENP018809 vlCDR1
RASQSVSNDVA

SEQ ID NO: 9066 - protein, 7 aa, Artificial Sequence
  Description of Artificial Sequence: Synthetic peptide
  XENP018809 vlCDR2
KASHRYT

SEQ ID NO: 9067 - protein, 9 aa, Artificial Sequence
  Description of Artificial Sequence: Synthetic peptide
  XENP018809 vlCDR3
QQDYSSPRT

SEQ ID NO: 9068 - protein, 249 aa, Artificial Sequence
  Description of Artificial Sequence: Synthetic polypeptide
  XENP018810 1G6_H1_L1.64_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASYRYTGVPDRFTGSGYGTEFTLTISSLQSEDFAVYFCQQDYSSPRTFGGGTKVEIK

SEQ ID NO: 9069 - protein, 122 aa, Artificial Sequence; identical to SEQ ID NO: 6246
  Description of Artificial Sequence: Synthetic polypeptide
  VH of XENP018810

SEQ ID NO: 9070 - protein, 107 aa, Artificial Sequence
  Description of Artificial Sequence: Synthetic polypeptide
  VL of XENP018810
SIVMTQSPATLSVSPGERATLSCRASQSVSNDVAWYQQKPGQSPRLLINYASYRYTGVPDRFTGSGYGTEFTLTISSLQSEDFAVYFCQQDYSSPRTFGGGTKVEIK

SEQ ID NO: 9071 - protein, 5 aa, Artificial Sequence
  Description of Artificial Sequence: Synthetic peptide
  XENP018810 vhCDR1
NYWMN

SEQ ID NO: 9072 - protein, 19 aa, Artificial Sequence
  Description of Artificial Sequence: Synthetic peptide
  XENP018810 vhCDR2
EIRLKSNNYATHYAEPVKG

SEQ ID NO: 9073 - protein, 11 aa, Artificial Sequence
  Description of Artificial Sequence: Synthetic peptide
  XENP018810 vhCDR3
YYGNYGGYFDV

SEQ ID NO: 9074 - protein, 11 aa, Artificial Sequence
  Description of Artificial Sequence: Synthetic peptide
  XENP018810 vlCDR1
RASQSVSNDVA

SEQ ID NO: 9075 - protein, 7 aa, Artificial Sequence
  Description of Artificial Sequence: Synthetic peptide
  XENP018810 vlCDR2
YASYRYT

SEQ ID NO: 9076 - protein, 9 aa, Artificial Sequence
  Description of Artificial Sequence: Synthetic peptide
  XENP018810 vlCDR3
QQDYSSPRT

SEQ ID NO: 9077 - protein, 249 aa, Artificial Sequence
  Description of Artificial Sequence: Synthetic polypeptide
  XENP018811 1G6_H1_L1.65_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASQRYTGVPDRFTGSGYGTEFTLTISSLQSEDFAVYFCQQDYSSPRTFGGGTKVEIK

SEQ ID NO: 9078 - protein, 122 aa, Artificial Sequence; identical to SEQ ID NO: 6246
  Description of Artificial Sequence: Synthetic polypeptide
  VH of XENP018811

SEQ ID NO: 9079 - protein, 107 aa, Artificial Sequence
  Description of Artificial Sequence: Synthetic polypeptide
  VL of XENP018811
SIVMTQSPATLSVSPGERATLSCRASQSVSNDVAWYQQKPGQSPRLLINYASQRYTGVPDRFTGSGYGTEFTLTISSLQSEDFAVYFCQQDYSSPRTFGGGTKVEIK

SEQ ID NO: 9080 - protein, 5 aa, Artificial Sequence
  Description of Artificial Sequence: Synthetic peptide
  XENP018811 vhCDR1
NYWMN

SEQ ID NO: 9081 - protein, 19 aa, Artificial Sequence
  Description of Artificial Sequence: Synthetic peptide
  XENP018811 vhCDR2
EIRLKSNNYATHYAEPVKG

SEQ ID NO: 9082 - protein, 11 aa, Artificial Sequence
  Description of Artificial Sequence: Synthetic peptide
  XENP018811 vhCDR3
YYGNYGGYFDV

SEQ ID NO: 9083 - protein, 11 aa, Artificial Sequence
  Description of Artificial Sequence: Synthetic peptide
  XENP018811 vlCDR1
RASQSVSNDVA

SEQ ID NO: 9084 - protein, 7 aa, Artificial Sequence
  Description of Artificial Sequence: Synthetic peptide
  XENP018811 vlCDR2
YASQRYT

SEQ ID NO: 9085 - protein, 9 aa, Artificial Sequence
  Description of Artificial Sequence: Synthetic peptide
  XENP018811 vlCDR3
QQDYSSPRT

SEQ ID NO: 9086 - protein, 249 aa, Artificial Sequence
  Description of Artificial Sequence: Synthetic polypeptide
  XENP018812 1G6_H1_L1.66_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASDRYTGVPDRFTGSGYGTEFTLTISSLQSEDFAVYFCQQDYSSPRTFGGGTKVEIK

SEQ ID NO: 9087 - protein, 122 aa, Artificial Sequence; identical to SEQ ID NO: 6246
  Description of Artificial Sequence: Synthetic polypeptide
  VH of XENP018812

SEQ ID NO: 9088 - protein, 107 aa, Artificial Sequence
  Description of Artificial Sequence: Synthetic polypeptide
  VL of XENP018812
SIVMTQSPATLSVSPGERATLSCRASQSVSNDVAWYQQKPGQSPRLLINYASDRYTGVPDRFTGSGYGTEFTLTISSLQSEDFAVYFCQQDYSSPRTFGGGTKVEIK

SEQ ID NO: 9089 - protein, 5 aa, Artificial Sequence
  Description of Artificial Sequence: Synthetic peptide
  XENP018812 vhCDR1
NYWMN

SEQ ID NO: 9090 - protein, 19 aa, Artificial Sequence
  Description of Artificial Sequence: Synthetic peptide
  XENP018812 vhCDR2
EIRLKSNNYATHYAEPVKG

SEQ ID NO: 9091 - protein, 11 aa, Artificial Sequence
  Description of Artificial Sequence: Synthetic peptide
  XENP018812 vhCDR3
YYGNYGGYFDV

SEQ ID NO: 9092 - protein, 11 aa, Artificial Sequence
  Description of Artificial Sequence: Synthetic peptide
  XENP018812 vlCDR1
RASQSVSNDVA

SEQ ID NO: 9093 - protein, 7 aa, Artificial Sequence
  Description of Artificial Sequence: Synthetic peptide
  XENP018812 vlCDR2
YASDRYT

SEQ ID NO: 9094 - protein, 9 aa, Artificial Sequence
  Description of Artificial Sequence: Synthetic peptide
  XENP018812 vlCDR3
QQDYSSPRT

SEQ ID NO: 9095 - protein, 249 aa, Artificial Sequence
  Description of Artificial Sequence: Synthetic polypeptide
  XENP018813 1G6_H1_L1.67_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASWRYTGVPDRFTGSGYGTEFTLTISSLQSEDFAVYFCQQDYSSPRTFGGGTKVEIK

SEQ ID NO: 9096 - protein, 122 aa, Artificial Sequence; identical to SEQ ID NO: 6246
  Description of Artificial Sequence: Synthetic polypeptide
  VH of XENP018813

SEQ ID NO: 9097 - protein, 107 aa, Artificial Sequence
  Description of Artificial Sequence: Synthetic polypeptide
  VL of XENP018813
SIVMTQSPATLSVSPGERATLSCRASQSVSNDVAWYQQKPGQSPRLLINYASWRYTGVPDRFTGSGYGTEFTLTISSLQSEDFAVYFCQQDYSSPRTFGGGTKVEIK

SEQ ID NO: 9098 - protein, 5 aa, Artificial Sequence
  Description of Artificial Sequence: Synthetic peptide
  XENP018813 vhCDR1
NYWMN

SEQ ID NO: 9099 - protein, 19 aa, Artificial Sequence
  Description of Artificial Sequence: Synthetic peptide
  XENP018813 vhCDR2
EIRLKSNNYATHYAEPVKG

SEQ ID NO: 9100 - protein, 11 aa, Artificial Sequence
  Description of Artificial Sequence: Synthetic peptide
  XENP018813 vhCDR3
YYGNYGGYFDV

SEQ ID NO: 9101 - protein, 11 aa, Artificial Sequence
  Description of Artificial Sequence: Synthetic peptide
  XENP018813 vlCDR1
RASQSVSNDVA

SEQ ID NO: 9102 - protein, 7 aa, Artificial Sequence
  Description of Artificial Sequence: Synthetic peptide
  XENP018813 vlCDR2
YASWRYT

SEQ ID NO: 9103 - protein, 9 aa, Artificial Sequence
  Description of Artificial Sequence: Synthetic peptide
  XENP018813 vlCDR3
QQDYSSPRT

SEQ ID NO: 9104 - protein, 249 aa, Artificial Sequence
  Description of Artificial Sequence: Synthetic polypeptide
  XENP018814 1G6_H1_L1.68_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASARYTGVPDRFTGSGYGTEFTLTISSLQSEDFAVYFCQQDYSSPRTFGGGTKVEIK

SEQ ID NO: 9105 - protein, 122 aa, Artificial Sequence; identical to SEQ ID NO: 6246
  Description of Artificial Sequence: Synthetic polypeptide
  VH of XENP018814

SEQ ID NO: 9106 - protein, 107 aa, Artificial Sequence
  Description of Artificial Sequence: Synthetic polypeptide
  VL of XENP018814
SIVMTQSPATLSVSPGERATLSCRASQSVSNDVAWYQQKPGQSPRLLINYASARYTGVPDRFTGSGYGTEFTLTISSLQSEDFAVYFCQQDYSSPRTFGGGTKVEIK

SEQ ID NO: 9107 - protein, 5 aa, Artificial Sequence
  Description of Artificial Sequence: Synthetic peptide
  XENP018814 vhCDR1
NYWMN

SEQ ID NO: 9108 - protein, 19 aa, Artificial Sequence
  Description of Artificial Sequence: Synthetic peptide
  XENP018814 vhCDR2
EIRLKSNNYATHYAEPVKG

SEQ ID NO: 9109 - protein, 11 aa, Artificial Sequence
  Description of Artificial Sequence: Synthetic peptide
  XENP018814 vhCDR3
YYGNYGGYFDV

SEQ ID NO: 9110 - protein, 11 aa, Artificial Sequence
  Description of Artificial Sequence: Synthetic peptide
  XENP018814 vlCDR1
RASQSVSNDVA

SEQ ID NO: 9111 - protein, 7 aa, Artificial Sequence
  Description of Artificial Sequence: Synthetic peptide
  XENP018814 vlCDR2
YASARYT

SEQ ID NO: 9112 - protein, 9 aa, Artificial Sequence
  Description of Artificial Sequence: Synthetic peptide
  XENP018814 vlCDR3
QQDYSSPRT

SEQ ID NO: 9113 - protein, 249 aa, Artificial Sequence
  Description of Artificial Sequence: Synthetic polypeptide
  XENP018815 1G6_H1_L1.69_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASTRYTGVPDRFTGSGYGTEFTLTISSLQSEDFAVYFCQQDYSSPRTFGGGTKVEIK

SEQ ID NO: 9114 - protein, 122 aa, Artificial Sequence; identical to SEQ ID NO: 6246
  Description of Artificial Sequence: Synthetic polypeptide
  VH of XENP018815

SEQ ID NO: 9115 - protein, 107 aa, Artificial Sequence
  Description of Artificial Sequence: Synthetic polypeptide
  VL of XENP018815
SIVMTQSPATLSVSPGERATLSCRASQSVSNDVAWYQQKPGQSPRLLINYASTRYTGVPDRFTGSGYGTEFTLTISSLQSEDFAVYFCQQDYSSPRTFGGGTKVEIK

SEQ ID NO: 9116 - protein, 5 aa, Artificial Sequence
  Description of Artificial Sequence: Synthetic peptide
  XENP018815 vhCDR1
NYWMN

SEQ ID NO: 9117 - protein, 19 aa, Artificial Sequence
  Description of Artificial Sequence: Synthetic peptide
  XENP018815 vhCDR2
EIRLKSNNYATHYAEPVKG

SEQ ID NO: 9118 - protein, 11 aa, Artificial Sequence
  Description of Artificial Sequence: Synthetic peptide
  XENP018815 vhCDR3
YYGNYGGYFDV

SEQ ID NO: 9119 - protein, 11 aa, Artificial Sequence
  Description of Artificial Sequence: Synthetic peptide
  XENP018815 vlCDR1
RASQSVSNDVA

SEQ ID NO: 9120 - protein, 7 aa, Artificial Sequence
  Description of Artificial Sequence: Synthetic peptide
  XENP018815 vlCDR2
YASTRYT

SEQ ID NO: 9121 - protein, 9 aa, Artificial Sequence
  Description of Artificial Sequence: Synthetic peptide
  XENP018815 vlCDR3
QQDYSSPRT

SEQ ID NO: 9122 - protein, 249 aa, Artificial Sequence
  Description of Artificial Sequence: Synthetic polypeptide
  XENP018816 1G6_H1_L1.70_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASKRYTGVPDRFTGSGYGTEFTLTISSLQSEDFAVYFCQQDYSSPRTFGGGTKVEIK

SEQ ID NO: 9123 - protein, 122 aa, Artificial Sequence; identical to SEQ ID NO: 6246
  Description of Artificial Sequence: Synthetic polypeptide
  VH of XENP018816

SEQ ID NO: 9124 - protein, 107 aa, Artificial Sequence
  Description of Artificial Sequence: Synthetic polypeptide
  VL of XENP018816
SIVMTQSPATLSVSPGERATLSCRASQSVSNDVAWYQQKPGQSPRLLINYASKRYTGVPDRFTGSGYGTEFTLTISSLQSEDFAVYFCQQDYSSPRTFGGGTKVEIK

SEQ ID NO: 9125 - protein, 5 aa, Artificial Sequence
  Description of Artificial Sequence: Synthetic peptide
  XENP018816 vhCDR1
NYWMN

SEQ ID NO: 9126 - protein, 19 aa, Artificial Sequence
  Description of Artificial Sequence: Synthetic peptide
  XENP018816 vhCDR2
EIRLKSNNYATHYAEPVKG

SEQ ID NO: 9127 - protein, 11 aa, Artificial Sequence
  Description of Artificial Sequence: Synthetic peptide
  XENP018816 vhCDR3
YYGNYGGYFDV

SEQ ID NO: 9128 - protein, 11 aa, Artificial Sequence
  Description of Artificial Sequence: Synthetic peptide
  XENP018816 vlCDR1
RASQSVSNDVA

SEQ ID NO: 9129 - protein, 7 aa, Artificial Sequence
  Description of Artificial Sequence: Synthetic peptide
  XENP018816 vlCDR2
YASKRYT

SEQ ID NO: 9130 - protein, 9 aa, Artificial Sequence
  Description of Artificial Sequence: Synthetic peptide
  XENP018816 vlCDR3
QQDYSSPRT

SEQ ID NO: 9131 - protein, 249 aa, Artificial Sequence
  Description of Artificial Sequence: Synthetic polypeptide
  XENP018817 1G6_H1_L1.71_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASGRYTGVPDRFTGSGYGTEFTLTISSLQSEDFAVYFCQQDYSSPRTFGGGTKVEIK

SEQ ID NO: 9132 - protein, 122 aa, Artificial Sequence; identical to SEQ ID NO: 6246
  Description of Artificial Sequence: Synthetic polypeptide
  VH of XENP018817

SEQ ID NO: 9133 - protein, 107 aa, Artificial Sequence
  Description of Artificial Sequence: Synthetic polypeptide
  VL of XENP018817
SIVMTQSPATLSVSPGERATLSCRASQSVSNDVAWYQQKPGQSPRLLINYASGRYTGVPDRFTGSGYGTEFTLTISSLQSEDFAVYFCQQDYSSPRTFGGGTKVEIK

SEQ ID NO: 9134 - protein, 5 aa, Artificial Sequence
  Description of Artificial Sequence: Synthetic peptide
  XENP018817 vhCDR1
NYWMN

SEQ ID NO: 9135 - protein, 19 aa, Artificial Sequence
  Description of Artificial Sequence: Synthetic peptide
  XENP018817 vhCDR2
EIRLKSNNYATHYAEPVKG

SEQ ID NO: 9136 - protein, 11 aa, Artificial Sequence
  Description of Artificial Sequence: Synthetic peptide
  XENP018817 vhCDR3
YYGNYGGYFDV

SEQ ID NO: 9137 - protein, 11 aa, Artificial Sequence
  Description of Artificial Sequence: Synthetic peptide
  XENP018817 vlCDR1
RASQSVSNDVA

SEQ ID NO: 9138 - protein, 7 aa, Artificial Sequence
  Description of Artificial Sequence: Synthetic peptide
  XENP018817 vlCDR2
YASGRYT

SEQ ID NO: 9139 - protein, 9 aa, Artificial Sequence
  Description of Artificial Sequence: Synthetic peptide
  XENP018817 vlCDR3
QQDYSSPRT

SEQ ID NO: 9140 - protein, 249 aa, Artificial Sequence
  Description of Artificial Sequence: Synthetic polypeptide
  XENP018818 1G6_H1_L1.72_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASLRYTGVPDRFTGSGYGTEFTLTISSLQSEDFAVYFCQQDYSSPRTFGGGTKVEIK

SEQ ID NO: 9141 - protein, 122 aa, Artificial Sequence; identical to SEQ ID NO: 6246
  Description of Artificial Sequence: Synthetic polypeptide
  VH of XENP018818

SEQ ID NO: 9142 - protein, 107 aa, Artificial Sequence
  Description of Artificial Sequence: Synthetic polypeptide
  VL of XENP018818
SIVMTQSPATLSVSPGERATLSCRASQSVSNDVAWYQQKPGQSPRLLINYASLRYTGVPDRFTGSGYGTEFTLTISSLQSEDFAVYFCQQDYSSPRTFGGGTKVEIK

SEQ ID NO: 9143 - protein, 5 aa, Artificial Sequence
  Description of Artificial Sequence: Synthetic peptide
  XENP018818 vhCDR1
NYWMN

SEQ ID NO: 9144 - protein, 19 aa, Artificial Sequence
  Description of Artificial Sequence: Synthetic peptide
  XENP018818 vhCDR2
EIRLKSNNYATHYAEPVKG

SEQ ID NO: 9145 - protein, 11 aa, Artificial Sequence
  Description of Artificial Sequence: Synthetic peptide
  XENP018818 vhCDR3
YYGNYGGYFDV

SEQ ID NO: 9146 - protein, 11 aa, Artificial Sequence
  Description of Artificial Sequence: Synthetic peptide
  XENP018818 vlCDR1
RASQSVSNDVA

SEQ ID NO: 9147 - protein, 7 aa, Artificial Sequence
  Description of Artificial Sequence: Synthetic peptide
  XENP018818 vlCDR2
YASLRYT

SEQ ID NO: 9148 - protein, 9 aa, Artificial Sequence
  Description of Artificial Sequence: Synthetic peptide
  XENP018818 vlCDR3
QQDYSSPRT

SEQ ID NO: 9149 - protein, 249 aa, Artificial Sequence
  Description of Artificial Sequence: Synthetic polypeptide
  XENP018819 1G6_H1_L1.73_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHLYTGVPDRFTGSGYGTEFTLTISSLQSEDFAVYFCQQDYSSPRTFGGGTKVEIK

SEQ ID NO: 9150 - protein, 122 aa, Artificial Sequence; identical to SEQ ID NO: 6246
  Description of Artificial Sequence: Synthetic polypeptide
  VH of XENP018819

SEQ ID NO: 9151 - protein, 107 aa, Artificial Sequence
  Description of Artificial Sequence: Synthetic polypeptide
  VL of XENP018819
SIVMTQSPATLSVSPGERATLSCRASQSVSNDVAWYQQKPGQSPRLLINYASHLYTGVPDRFTGSGYGTEFTLTISSLQSEDFAVYFCQQDYSSPRTFGGGTKVEIK

SEQ ID NO: 9152 - protein, 5 aa, Artificial Sequence
  Description of Artificial Sequence: Synthetic peptide
  XENP018819 vhCDR1
NYWMN

SEQ ID NO: 9153 - protein, 19 aa, Artificial Sequence
  Description of Artificial Sequence: Synthetic peptide
  XENP018819 vhCDR2
EIRLKSNNYATHYAEPVKG

SEQ ID NO: 9154 - protein, 11 aa, Artificial Sequence
  Description of Artificial Sequence: Synthetic peptide
  XENP018819 vhCDR3
YYGNYGGYFDV

SEQ ID NO: 9155 - protein, 11 aa, Artificial Sequence
  Description of Artificial Sequence: Synthetic peptide
  XENP018819 vlCDR1
RASQSVSNDVA

SEQ ID NO: 9156 - protein, 7 aa, Artificial Sequence
  Description of Artificial Sequence: Synthetic peptide
  XENP018819 vlCDR2
YASHLYT

SEQ ID NO: 9157 - protein, 9 aa, Artificial Sequence
  Description of Artificial Sequence: Synthetic peptide
  XENP018819 vlCDR3
QQDYSSPRT

SEQ ID NO: 9158 - protein, 249 aa, Artificial Sequence
  Description of Artificial Sequence: Synthetic polypeptide
  XENP018820 1G6_H1_L1.74_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHWYTGVPDRFTGSGYGTEFTLTISSLQSEDFAVYFCQQDYSSPRTFGGGTKVEIK

SEQ ID NO: 9159 - protein, 122 aa, Artificial Sequence; identical to SEQ ID NO: 6246
  Description of Artificial Sequence: Synthetic polypeptide
  VH of XENP018820

SEQ ID NO: 9160 - protein, 107 aa, Artificial Sequence
  Description of Artificial Sequence: Synthetic polypeptide
  VL of XENP018820
SIVMTQSPATLSVSPGERATLSCRASQSVSNDVAWYQQKPGQSPRLLINYASHWYTGVPDRFTGSGYGTEFTLTISSLQSEDFAVYFCQQDYSSPRTFGGGTKVEIK

SEQ ID NO: 9161 - protein, 5 aa, Artificial Sequence
  Description of Artificial Sequence: Synthetic peptide
  XENP018820 vhCDR1
NYWMN

SEQ ID NO: 9162 - protein, 19 aa, Artificial Sequence
  Description of Artificial Sequence: Synthetic peptide
  XENP018820 vhCDR2
EIRLKSNNYATHYAEPVKG

SEQ ID NO: 9163 - protein, 11 aa, Artificial Sequence
  Description of Artificial Sequence: Synthetic peptide
  XENP018820 vhCDR3
YYGNYGGYFDV

SEQ ID NO: 9164 - protein, 11 aa, Artificial Sequence
  Description of Artificial Sequence: Synthetic peptide
  XENP018820 vlCDR1
RASQSVSNDVA

SEQ ID NO: 9165 - protein, 7 aa, Artificial Sequence
  Description of Artificial Sequence: Synthetic peptide
  XENP018820 vlCDR2
YASHWYT

SEQ ID NO: 9166 - protein, 9 aa, Artificial Sequence
  Description of Artificial Sequence: Synthetic peptide
  XENP018820 vlCDR3
QQDYSSPRT

SEQ ID NO: 9167 - protein, 249 aa, Artificial Sequence
  Description of Artificial Sequence: Synthetic polypeptide
  XENP018821 1G6_H1_L1.75_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHSYTGVPDRFTGSGYGTEFTLTISSLQSEDFAVYFCQQDYSSPRTFGGGTKVEIK

SEQ ID NO: 9168 - protein, 122 aa, Artificial Sequence; identical to SEQ ID NO: 6246
  Description of Artificial Sequence: Synthetic polypeptide
  VH of XENP018821

SEQ ID NO: 9169 - protein, 107 aa, Artificial Sequence
  Description of Artificial Sequence: Synthetic polypeptide
  VL of XENP018821
SIVMTQSPATLSVSPGERATLSCRASQSVSNDVAWYQQKPGQSPRLLINYASHSYTGVPDRFTGSGYGTEFTLTISSLQSEDFAVYFCQQDYSSPRTFGGGTKVEIK

SEQ ID NO: 9170 - protein, 5 aa, Artificial Sequence
  Description of Artificial Sequence: Synthetic peptide
  XENP018821 vhCDR1
NYWMN

SEQ ID NO: 9171 - protein, 19 aa, Artificial Sequence
  Description of Artificial Sequence: Synthetic peptide
  XENP018821 vhCDR2
EIRLKSNNYATHYAEPVKG

SEQ ID NO: 9172 - protein, 11 aa, Artificial Sequence
  Description of Artificial Sequence: Synthetic peptide
  XENP018821 vhCDR3
YYGNYGGYFDV

SEQ ID NO: 9173 - protein, 11 aa, Artificial Sequence
  Description of Artificial Sequence: Synthetic peptide
  XENP018821 vlCDR1
RASQSVSNDVA

SEQ ID NO: 9174 - protein, 7 aa, Artificial Sequence
  Description of Artificial Sequence: Synthetic peptide
  XENP018821 vlCDR2
YASHSYT

SEQ ID NO: 9175 - protein, 9 aa, Artificial Sequence
  Description of Artificial Sequence: Synthetic peptide
  XENP018821 vlCDR3
QQDYSSPRT

SEQ ID NO: 9176 - protein, 249 aa, Artificial Sequence
  Description of Artificial Sequence: Synthetic polypeptide
  XENP018822 1G6_H1_L1.76_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRFTGVPDRFTGSGYGTEFTLTISSLQSEDFAVYFCQQDYSSPRTFGGGTKVEIK

SEQ ID NO: 9177 - protein, 122 aa, Artificial Sequence; identical to SEQ ID NO: 6246
  Description of Artificial Sequence: Synthetic polypeptide
  VH of XENP018822

SEQ ID NO: 9178 - protein, 107 aa, Artificial Sequence
  Description of Artificial Sequence: Synthetic polypeptide
  VL of XENP018822
SIVMTQSPATLSVSPGERATLSCRASQSVSNDVAWYQQKPGQSPRLLINYASHRFTGVPDRFTGSGYGTEFTLTISSLQSEDFAVYFCQQDYSSPRTFGGGTKVEIK

SEQ ID NO: 9179 - protein, 5 aa, Artificial Sequence
  Description of Artificial Sequence: Synthetic peptide
  XENP018822 vhCDR1
NYWMN

SEQ ID NO: 9180 - protein, 19 aa, Artificial Sequence
  Description of Artificial Sequence: Synthetic peptide
  XENP018822 vhCDR2
EIRLKSNNYATHYAEPVKG

SEQ ID NO: 9181 - protein, 11 aa, Artificial Sequence
  Description of Artificial Sequence: Synthetic peptide
  XENP018822 vhCDR3
YYGNYGGYFDV

SEQ ID NO: 9182 - protein, 11 aa, Artificial Sequence
  Description of Artificial Sequence: Synthetic peptide
  XENP018822 vlCDR1
RASQSVSNDVA

SEQ ID NO: 9183 - protein, 7 aa, Artificial Sequence
  Description of Artificial Sequence: Synthetic peptide
  XENP018822 vlCDR2
YASHRFT

SEQ ID NO: 9184 - protein, 9 aa, Artificial Sequence
  Description of Artificial Sequence: Synthetic peptide
  XENP018822 vlCDR3
QQDYSSPRT

SEQ ID NO: 9185 - protein, 249 aa, Artificial Sequence
  Description of Artificial Sequence: Synthetic polypeptide
  XENP018823 1G6_H1_L1.77_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRHTGVPDRFTGSGYGTEFTLTISSLQSEDFAVYFCQQDYSSPRTFGGGTKVEIK

SEQ ID NO: 9186 - protein, 122 aa, Artificial Sequence; identical to SEQ ID NO: 6246
  Description of Artificial Sequence: Synthetic polypeptide
  VH of XENP018823

SEQ ID NO: 9187 - protein, 107 aa, Artificial Sequence
  Description of Artificial Sequence: Synthetic polypeptide
  VL of XENP018823
SIVMTQSPATLSVSPGERATLSCRASQSVSNDVAWYQQKPGQSPRLLINYASHRHTGVPDRFTGSGYGTEFTLTISSLQSEDFAVYFCQQDYSSPRTFGGGTKVEIK

SEQ ID NO: 9188 - protein, 5 aa, Artificial Sequence
  Description of Artificial Sequence: Synthetic peptide
  XENP018823 vhCDR1
NYWMN

SEQ ID NO: 9189 - protein, 19 aa, Artificial Sequence
  Description of Artificial Sequence: Synthetic peptide
  XENP018823 vhCDR2
EIRLKSNNYATHYAEPVKG

SEQ ID NO: 9190 - protein, 11 aa, Artificial Sequence
  Description of Artificial Sequence: Synthetic peptide
  XENP018823 vhCDR3
YYGNYGGYFDV

SEQ ID NO: 9191 - protein, 11 aa, Artificial Sequence
  Description of Artificial Sequence: Synthetic peptide
  XENP018823 vlCDR1
RASQSVSNDVA

SEQ ID NO: 9192 - protein, 7 aa, Artificial Sequence
  Description of Artificial Sequence: Synthetic peptide
  XENP018823 vlCDR2
YASHRHT

SEQ ID NO: 9193 - protein, 9 aa, Artificial Sequence
  Description of Artificial Sequence: Synthetic peptide
  XENP018823 vlCDR3
QQDYSSPRT

SEQ ID NO: 9194 - protein, 249 aa, Artificial Sequence
  Description of Artificial Sequence: Synthetic polypeptide
  XENP018824 1G6_H1_L1.78_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRLTGVPDRFTGSGYGTEFTLTISSLQSEDFAVYFCQQDYSSPRTFGGGTKVEIK

SEQ ID NO: 9195 - protein, 122 aa, Artificial Sequence; identical to SEQ ID NO: 6246
  Description of Artificial Sequence: Synthetic polypeptide
  VH of XENP018824

SEQ ID NO: 9196 - protein, 107 aa, Artificial Sequence
  Description of Artificial Sequence: Synthetic polypeptide
  VL of XENP018824
SIVMTQSPATLSVSPGERATLSCRASQSVSNDVAWYQQKPGQSPRLLINYASHRLTGVPDRFTGSGYGTEFTLTISSLQSEDFAVYFCQQDYSSPRTFGGGTKVEIK

SEQ ID NO: 9197 - protein, 5 aa, Artificial Sequence
  Description of Artificial Sequence: Synthetic peptide
  XENP018824 vhCDR1
NYWMN

SEQ ID NO: 9198 - protein, 19 aa, Artificial Sequence
  Description of Artificial Sequence: Synthetic peptide
  XENP018824 vhCDR2
EIRLKSNNYATHYAEPVKG

SEQ ID NO: 9199 - protein, 11 aa, Artificial Sequence
  Description of Artificial Sequence: Synthetic peptide
  XENP018824 vhCDR3
YYGNYGGYFDV

SEQ ID NO: 9200 - protein, 11 aa, Artificial Sequence
  Description of Artificial Sequence: Synthetic peptide
  XENP018824 vlCDR1
RASQSVSNDVA

SEQ ID NO: 9201 - protein, 7 aa, Artificial Sequence
  Description of Artificial Sequence: Synthetic peptide
  XENP018824 vlCDR2
YASHRLT

SEQ ID NO: 9202 - protein, 9 aa, Artificial Sequence
  Description of Artificial Sequence: Synthetic peptide
  XENP018824 vlCDR3
QQDYSSPRT

SEQ ID NO: 9203 - protein, 249 aa, Artificial Sequence
  Description of Artificial Sequence: Synthetic polypeptide
  XENP018825 1G6_H1_L1.79_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRWTGVPDRFTGSGYGTEFTLTISSLQSEDFAVYFCQQDYSSPRTFGGGTKVEIK

SEQ ID NO: 9204 - protein, 122 aa, Artificial Sequence; identical to SEQ ID NO: 6246
  Description of Artificial Sequence: Synthetic polypeptide
  VH of XENP018825

SEQ ID NO: 9205 - protein, 107 aa, Artificial Sequence
  Description of Artificial Sequence: Synthetic polypeptide
  VL of XENP018825
SIVMTQSPATLSVSPGERATLSCRASQSVSNDVAWYQQKPGQSPRLLINYASHRWTGVPDRFTGSGYGTEFTLTISSLQSEDFAVYFCQQDYSSPRTFGGGTKVEIK

SEQ ID NO: 9206 - protein, 5 aa, Artificial Sequence
  Description of Artificial Sequence: Synthetic peptide
  XENP018825 vhCDR1
NYWMN

SEQ ID NO: 9207 - protein, 19 aa, Artificial Sequence
  Description of Artificial Sequence: Synthetic peptide
  XENP018825 vhCDR2
EIRLKSNNYATHYAEPVKG

SEQ ID NO: 9208 - protein, 11 aa, Artificial Sequence
  Description of Artificial Sequence: Synthetic peptide
  XENP018825 vhCDR3
YYGNYGGYFDV

SEQ ID NO: 9209 - protein, 11 aa, Artificial Sequence
  Description of Artificial Sequence: Synthetic peptide
  XENP018825 vlCDR1
RASQSVSNDVA

SEQ ID NO: 9210 - protein, 7 aa, Artificial Sequence
  Description of Artificial Sequence: Synthetic peptide
  XENP018825 vlCDR2
YASHRWT

SEQ ID NO: 9211 - protein, 9 aa, Artificial Sequence
  Description of Artificial Sequence: Synthetic peptide
  XENP018825 vlCDR3
QQDYSSPRT

SEQ ID NO: 9212 - protein, 249 aa, Artificial Sequence
  Description of Artificial Sequence: Synthetic polypeptide
  XENP018826 1G6_H1_L1.80_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRVTGVPDRFTGSGYGTEFTLTISSLQSEDFAVYFCQQDYSSPRTFGGGTKVEIK

SEQ ID NO: 9213 - protein, 122 aa, Artificial Sequence; identical to SEQ ID NO: 6246
  Description of Artificial Sequence: Synthetic polypeptide
  VH of XENP018826

SEQ ID NO: 9214 - protein, 107 aa, Artificial Sequence
  Description of Artificial Sequence: Synthetic polypeptide
  VL of XENP018826
SIVMTQSPATLSVSPGERATLSCRASQSVSNDVAWYQQKPGQSPRLLINYASHRVTGVPDRFTGSGYGTEFTLTISSLQSEDFAVYFCQQDYSSPRTFGGGTKVEIK

SEQ ID NO: 9215 - protein, 5 aa, Artificial Sequence
  Description of Artificial Sequence: Synthetic peptide
  XENP018826 vhCDR1
NYWMN

SEQ ID NO: 9216 - protein, 19 aa, Artificial Sequence
  Description of Artificial Sequence: Synthetic peptide
  XENP018826 vhCDR2
EIRLKSNNYATHYAEPVKG

SEQ ID NO: 9217 - protein, 11 aa, Artificial Sequence
  Description of Artificial Sequence: Synthetic peptide
  XENP018826 vhCDR3
YYGNYGGYFDV

SEQ ID NO: 9218 - protein, 11 aa, Artificial Sequence
  Description of Artificial Sequence: Synthetic peptide
  XENP018826 vlCDR1
RASQSVSNDVA

SEQ ID NO: 9219 - protein, 7 aa, Artificial Sequence
  Description of Artificial Sequence: Synthetic peptide
  XENP018826 vlCDR2
YASHRVT

SEQ ID NO: 9220 - protein, 9 aa, Artificial Sequence
  Description of Artificial Sequence: Synthetic peptide
  XENP018826 vlCDR3
QQDYSSPRT

SEQ ID NO: 9221 - protein, 249 aa, Artificial Sequence
  Description of Artificial Sequence: Synthetic polypeptide
  XENP018827 1G6_H1_L1.81_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRATGVPDRFTGSGYGTEFTLTISSLQSEDFAVYFCQQDYSSPRTFGGGTKVEIK

SEQ ID NO: 9222 - protein, 122 aa, Artificial Sequence; identical to SEQ ID NO: 6246
  Description of Artificial Sequence: Synthetic polypeptide
  VH of XENP018827

SEQ ID NO: 9223 - protein, 107 aa, Artificial Sequence
  Description of Artificial Sequence: Synthetic polypeptide
  VL of XENP018827
SIVMTQSPATLSVSPGERATLSCRASQSVSNDVAWYQQKPGQSPRLLINYASHRATGVPDRFTGSGYGTEFTLTISSLQSEDFAVYFCQQDYSSPRTFGGGTKVEIK

SEQ ID NO: 9224 - protein, 5 aa, Artificial Sequence
  Description of Artificial Sequence: Synthetic peptide
  XENP018827 vhCDR1
NYWMN

SEQ ID NO: 9225 - protein, 19 aa, Artificial Sequence
  Description of Artificial Sequence: Synthetic peptide
  XENP018827 vhCDR2
EIRLKSNNYATHYAEPVKG

SEQ ID NO: 9226 - protein, 11 aa, Artificial Sequence
  Description of Artificial Sequence: Synthetic peptide
  XENP018827 vhCDR3
YYGNYGGYFDV

SEQ ID NO: 9227 - protein, 11 aa, Artificial Sequence
  Description of Artificial Sequence: Synthetic peptide
  XENP018827 vlCDR1
RASQSVSNDVA

SEQ ID NO: 9228 - protein, 7 aa, Artificial Sequence
  Description of Artificial Sequence: Synthetic peptide
  XENP018827 vlCDR2
YASHRAT

SEQ ID NO: 9229 - protein, 9 aa, Artificial Sequence
  Description of Artificial Sequence: Synthetic peptide
  XENP018827 vlCDR3
QQDYSSPRT

SEQ ID NO: 9230 - protein, 249 aa, Artificial Sequence
  Description of Artificial Sequence: Synthetic polypeptide
  XENP018828 1G6_H1_L1.82_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRQTGVPDRFTGSGYGTEFTLTISSLQSEDFAVYFCQQDYSSPRTFGGGTKVEIK

SEQ ID NO: 9231 - protein, 122 aa, Artificial Sequence; identical to SEQ ID NO: 6246
  Description of Artificial Sequence: Synthetic polypeptide
  VH of XENP018828

SEQ ID NO: 9232 - protein, 107 aa, Artificial Sequence
  Description of Artificial Sequence: Synthetic polypeptide
  VL of XENP018828
SIVMTQSPATLSVSPGERATLSCRASQSVSNDVAWYQQKPGQSPRLLINYASHRQTGVPDRFTGSGYGTEFTLTISSLQSEDFAVYFCQQDYSSPRTFGGGTKVEIK

SEQ ID NO: 9233 - protein, 5 aa, Artificial Sequence
  Description of Artificial Sequence: Synthetic peptide
  XENP018828 vhCDR1
NYWMN

SEQ ID NO: 9234 - protein, 19 aa, Artificial Sequence
  Description of Artificial Sequence: Synthetic peptide
  XENP018828 vhCDR2
EIRLKSNNYATHYAEPVKG

SEQ ID NO: 9235 - protein, 11 aa, Artificial Sequence
  Description of Artificial Sequence: Synthetic peptide
  XENP018828 vhCDR3
YYGNYGGYFDV

SEQ ID NO: 9236 - protein, 11 aa, Artificial Sequence
  Description of Artificial Sequence: Synthetic peptide
  XENP018828 vlCDR1
RASQSVSNDVA

SEQ ID NO: 9237 - protein, 7 aa, Artificial Sequence
  Description of Artificial Sequence: Synthetic peptide
  XENP018828 vlCDR2
YASHRQT

SEQ ID NO: 9238 - protein, 9 aa, Artificial Sequence
  Description of Artificial Sequence: Synthetic peptide
  XENP018828 vlCDR3
QQDYSSPRT

SEQ ID NO: 9239 - protein, 249 aa, Artificial Sequence
  Description of Artificial Sequence: Synthetic polypeptide
  XENP018829 1G6_H1_L1.83_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRDTGVPDRFTGSGYGTEFTLTISSLQSEDFAVYFCQQDYSSPRTFGGGTKVEIK

SEQ ID NO: 9240 - protein, 122 aa, Artificial Sequence; identical to SEQ ID NO: 6246
  Description of Artificial Sequence: Synthetic polypeptide
  VH of XENP018829

SEQ ID NO: 9241 - protein, 107 aa, Artificial Sequence
  Description of Artificial Sequence: Synthetic polypeptide
  VL of XENP018829
SIVMTQSPATLSVSPGERATLSCRASQSVSNDVAWYQQKPGQSPRLLINYASHRDTGVPDRFTGSGYGTEFTLTISSLQSEDFAVYFCQQDYSSPRTFGGGTKVEIK

SEQ ID NO: 9242 - protein, 5 aa, Artificial Sequence
  Description of Artificial Sequence: Synthetic peptide
  XENP018829 vhCDR1
NYWMN

SEQ ID NO: 9243 - protein, 19 aa, Artificial Sequence
  Description of Artificial Sequence: Synthetic peptide
  XENP018829 vhCDR2
EIRLKSNNYATHYAEPVKG

SEQ ID NO: 9244 - protein, 11 aa, Artificial Sequence
  Description of Artificial Sequence: Synthetic peptide
  XENP018829 vhCDR3
YYGNYGGYFDV

SEQ ID NO: 9245 - protein, 11 aa, Artificial Sequence
  Description of Artificial Sequence: Synthetic peptide
  XENP018829 vlCDR1
RASQSVSNDVA

SEQ ID NO: 9246 - protein, 7 aa, Artificial Sequence
  Description of Artificial Sequence: Synthetic peptide
  XENP018829 vlCDR2
YASHRDT

SEQ ID NO: 9247 - protein, 9 aa, Artificial Sequence
  Description of Artificial Sequence: Synthetic peptide
  XENP018829 vlCDR3
QQDYSSPRT

SEQ ID NO: 9248 - protein, 249 aa, Artificial Sequence
  Description of Artificial Sequence: Synthetic polypeptide
  XENP018830 1G6_H1_L1.84_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRKTGVPDRFTGSGYGTEFTLTISSLQSEDFAVYFCQQDYSSPRTFGGGTKVEIK

SEQ ID NO: 9249 - protein, 122 aa, Artificial Sequence; identical to SEQ ID NO: 6246
  Description of Artificial Sequence: Synthetic polypeptide
  VH of XENP018830

SEQ ID NO: 9250 - protein, 107 aa, Artificial Sequence
  Description of Artificial Sequence: Synthetic polypeptide
  VL of XENP018830
SIVMTQSPATLSVSPGERATLSCRASQSVSNDVAWYQQKPGQSPRLLINYASHRKTGVPDRFTGSGYGTEFTLTISSLQSEDFAVYFCQQDYSSPRTFGGGTKVEIK

SEQ ID NO: 9251 - protein, 5 aa, Artificial Sequence
  Description of Artificial Sequence: Synthetic peptide
  XENP018830 vhCDR1
NYWMN

SEQ ID NO: 9252 - protein, 19 aa, Artificial Sequence
  Description of Artificial Sequence: Synthetic peptide
  XENP018830 vhCDR2
EIRLKSNNYATHYAEPVKG

SEQ ID NO: 9253 - protein, 11 aa, Artificial Sequence
  Description of Artificial Sequence: Synthetic peptide
  XENP018830 vhCDR3
YYGNYGGYFDV

SEQ ID NO: 9254 - protein, 11 aa, Artificial Sequence
  Description of Artificial Sequence: Synthetic peptide
  XENP018830 vlCDR1
RASQSVSNDVA

SEQ ID NO: 9255 - protein, 7 aa, Artificial Sequence
  Description of Artificial Sequence: Synthetic peptide
  XENP018830 vlCDR2
YASHRKT

SEQ ID NO: 9256 - protein, 9 aa, Artificial Sequence
  Description of Artificial Sequence: Synthetic peptide
  XENP018830 vlCDR3
QQDYSSPRT

SEQ ID NO: 9257 - protein, 249 aa, Artificial Sequence
  Description of Artificial Sequence: Synthetic polypeptide
  XENP018831 1G6_H1_L1.85_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYVGVPDRFTGSGYGTEFTLTISSLQSEDFAVYFCQQDYSSPRTFGGGTKVEIK

SEQ ID NO: 9258 - protein, 122 aa, Artificial Sequence; identical to SEQ ID NO: 6246
  Description of Artificial Sequence: Synthetic polypeptide
  VH of XENP018831

SEQ ID NO: 9259 - protein, 107 aa, Artificial Sequence
  Description of Artificial Sequence: Synthetic polypeptide
  VL of XENP018831
SIVMTQSPATLSVSPGERATLSCRASQSVSNDVAWYQQKPGQSPRLLINYASHRYVGVPDRFTGSGYGTEFTLTISSLQSEDFAVYFCQQDYSSPRTFGGGTKVEIK

SEQ ID NO: 9260 - protein, 5 aa, Artificial Sequence
  Description of Artificial Sequence: Synthetic peptide
  XENP018831 vhCDR1
NYWMN

SEQ ID NO: 9261 - protein, 19 aa, Artificial Sequence
  Description of Artificial Sequence: Synthetic peptide
  XENP018831 vhCDR2
EIRLKSNNYATHYAEPVKG

SEQ ID NO: 9262 - protein, 11 aa, Artificial Sequence
  Description of Artificial Sequence: Synthetic peptide
  XENP018831 vhCDR3
YYGNYGGYFDV

SEQ ID NO: 9263 - protein, 11 aa, Artificial Sequence
  Description of Artificial Sequence: Synthetic peptide
  XENP018831 vlCDR1
RASQSVSNDVA

SEQ ID NO: 9264 - protein, 7 aa, Artificial Sequence
  Description of Artificial Sequence: Synthetic peptide
  XENP018831 vlCDR2
YASHRYV

SEQ ID NO: 9265 - protein, 9 aa, Artificial Sequence
  Description of Artificial Sequence: Synthetic peptide
  XENP018831 vlCDR3
QQDYSSPRT

SEQ ID NO: 9266 - protein, 249 aa, Artificial Sequence
  Description of Artificial Sequence: Synthetic polypeptide
  XENP018832 1G6_H1_L1.86_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYSGVPDRFTGSGYGTEFTLTISSLQSEDFAVYFCQQDYSSPRTFGGGTKVEIK

SEQ ID NO: 9267 - protein, 122 aa, Artificial Sequence; identical to SEQ ID NO: 6246
  Description of Artificial Sequence: Synthetic polypeptide
  VH of XENP018832

SEQ ID NO: 9268 - protein, 107 aa, Artificial Sequence
  Description of Artificial Sequence: Synthetic polypeptide
  VL of XENP018832
SIVMTQSPATLSVSPGERATLSCRASQSVSNDVAWYQQKPGQSPRLLINYASHRYSGVPDRFTGSGYGTEFTLTISSLQSEDFAVYFCQQDYSSPRTFGGGTKVEIK

SEQ ID NO: 9269 - protein, 5 aa, Artificial Sequence
  Description of Artificial Sequence: Synthetic peptide
  XENP018832 vhCDR1
NYWMN

SEQ ID NO: 9270 - protein, 19 aa, Artificial Sequence
  Description of Artificial Sequence: Synthetic peptide
  XENP018832 vhCDR2
EIRLKSNNYATHYAEPVKG

SEQ ID NO: 9271 - protein, 11 aa, Artificial Sequence
  Description of Artificial Sequence: Synthetic peptide
  XENP018832 vhCDR3
YYGNYGGYFDV

SEQ ID NO: 9272 - protein, 11 aa, Artificial Sequence
  Description of Artificial Sequence: Synthetic peptide
  XENP018832 vlCDR1
RASQSVSNDVA

SEQ ID NO: 9273 - protein, 7 aa, Artificial Sequence
  Description of Artificial Sequence: Synthetic peptide
  XENP018832 vlCDR2
YASHRYS

SEQ ID NO: 9274 - protein, 9 aa, Artificial Sequence
  Description of Artificial Sequence: Synthetic peptide
  XENP018832 vlCDR3
QQDYSSPRT

SEQ ID NO: 9275 - protein, 249 aa, Artificial Sequence
  Description of Artificial Sequence: Synthetic polypeptide
  XENP018833 1G6_H1_L1.87_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYAGVPDRFTGSGYGTEFTLTISSLQSEDFAVYFCQQDYSSPRTFGGGTKVEIK

SEQ ID NO: 9276 - protein, 122 aa, Artificial Sequence; identical to SEQ ID NO: 6246
  Description of Artificial Sequence: Synthetic polypeptide
  VH of XENP018833

SEQ ID NO: 9277 - protein, 107 aa, Artificial Sequence
  Description of Artificial Sequence: Synthetic polypeptide
  VL of XENP018833
SIVMTQSPATLSVSPGERATLSCRASQSVSNDVAWYQQKPGQSPRLLINYASHRYAGVPDRFTGSGYGTEFTLTISSLQSEDFAVYFCQQDYSSPRTFGGGTKVEIK

SEQ ID NO: 9278 - protein, 5 aa, Artificial Sequence
  Description of Artificial Sequence: Synthetic peptide
  XENP018833 vhCDR1
NYWMN

SEQ ID NO: 9279 - protein, 19 aa, Artificial Sequence
  Description of Artificial Sequence: Synthetic peptide
  XENP018833 vhCDR2
EIRLKSNNYATHYAEPVKG

SEQ ID NO: 9280 - protein, 11 aa, Artificial Sequence
  Description of Artificial Sequence: Synthetic peptide
  XENP018833 vhCDR3
YYGNYGGYFDV

SEQ ID NO: 9281 - protein, 11 aa, Artificial Sequence
  Description of Artificial Sequence: Synthetic peptide
  XENP018833 vlCDR1
RASQSVSNDVA

SEQ ID NO: 9282 - protein, 7 aa, Artificial Sequence
  Description of Artificial Sequence: Synthetic peptide
  XENP018833 vlCDR2
YASHRYA

SEQ ID NO: 9283 - protein, 9 aa, Artificial Sequence
  Description of Artificial Sequence: Synthetic peptide
  XENP018833 vlCDR3
QQDYSSPRT

SEQ ID NO: 9284 - protein, 249 aa, Artificial Sequence
  Description of Artificial Sequence: Synthetic polypeptide
  XENP018834 1G6_H1_L1.88_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYIGVPDRFTGSGYGTEFTLTISSLQSEDFAVYFCQQDYSSPRTFGGGTKVEIK

SEQ ID NO: 9285 - protein, 122 aa, Artificial Sequence; identical to SEQ ID NO: 6246
  Description of Artificial Sequence: Synthetic polypeptide
  VH of XENP018834

SEQ ID NO: 9286 - protein, 107 aa, Artificial Sequence
  Description of Artificial Sequence: Synthetic polypeptide
  VL of XENP018834
SIVMTQSPATLSVSPGERATLSCRASQSVSNDVAWYQQKPGQSPRLLINYASHRYIGVPDRFTGSGYGTEFTLTISSLQSEDFAVYFCQQDYSSPRTFGGGTKVEIK

SEQ ID NO: 9287 - protein, 5 aa, Artificial Sequence
  Description of Artificial Sequence: Synthetic peptide
  XENP018834 vhCDR1
NYWMN

SEQ ID NO: 9288 - protein, 19 aa, Artificial Sequence
  Description of Artificial Sequence: Synthetic peptide
  XENP018834 vhCDR2
EIRLKSNNYATHYAEPVKG

SEQ ID NO: 9289 - protein, 11 aa, Artificial Sequence
  Description of Artificial Sequence: Synthetic peptide
  XENP018834 vhCDR3
YYGNYGGYFDV

SEQ ID NO: 9290 - protein, 11 aa, Artificial Sequence
  Description of Artificial Sequence: Synthetic peptide
  XENP018834 vlCDR1
RASQSVSNDVA

SEQ ID NO: 9291 - protein, 7 aa, Artificial Sequence
  Description of Artificial Sequence: Synthetic peptide
  XENP018834 vlCDR2
YASHRYI

SEQ ID NO: 9292 - protein, 9 aa, Artificial Sequence
  Description of Artificial Sequence: Synthetic peptide
  XENP018834 vlCDR3
QQDYSSPRT

SEQ ID NO: 9293 - protein, 249 aa, Artificial Sequence
  Description of Artificial Sequence: Synthetic polypeptide
  XENP018835 1G6_H1_L1.89_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYQGVPDRFTGSGYGTEFTLTISSLQSEDFAVYFCQQDYSSPRTFGGGTKVEIK

SEQ ID NO: 9294 - protein, 122 aa, Artificial Sequence; identical to SEQ ID NO: 6246
  Description of Artificial Sequence: Synthetic polypeptide
  VH of XENP018835

SEQ ID NO: 9295 - protein, 107 aa, Artificial Sequence
  Description of Artificial Sequence: Synthetic polypeptide
  VL of XENP018835
SIVMTQSPATLSVSPGERATLSCRASQSVSNDVAWYQQKPGQSPRLLINYASHRYQGVPDRFTGSGYGTEFTLTISSLQSEDFAVYFCQQDYSSPRTFGGGTKVEIK

SEQ ID NO: 9296 - protein, 5 aa, Artificial Sequence
  Description of Artificial Sequence: Synthetic peptide
  XENP018835 vhCDR1
NYWMN

SEQ ID NO: 9297 - protein, 19 aa, Artificial Sequence
  Description of Artificial Sequence: Synthetic peptide
  XENP018835 vhCDR2
EIRLKSNNYATHYAEPVKG

SEQ ID NO: 9298 - protein, 11 aa, Artificial Sequence
  Description of Artificial Sequence: Synthetic peptide
  XENP018835 vhCDR3
YYGNYGGYFDV

SEQ ID NO: 9299 - protein, 11 aa, Artificial Sequence
  Description of Artificial Sequence: Synthetic peptide
  XENP018835 vlCDR1
RASQSVSNDVA

SEQ ID NO: 9300 - protein, 7 aa, Artificial Sequence
  Description of Artificial Sequence: Synthetic peptide
  XENP018835 vlCDR2
YASHRYQ

SEQ ID NO: 9301 - protein, 9 aa, Artificial Sequence
  Description of Artificial Sequence: Synthetic peptide
  XENP018835 vlCDR3
QQDYSSPRT

SEQ ID NO: 9302 - protein, 249 aa, Artificial Sequence
  Description of Artificial Sequence: Synthetic polypeptide
  XENP018836 1G6_H1_L1.90_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYHGVPDRFTGSGYGTEFTLTISSLQSEDFAVYFCQQDYSSPRTFGGGTKVEIK

SEQ ID NO: 9303 - protein, 122 aa, Artificial Sequence; identical to SEQ ID NO: 6246
  Description of Artificial Sequence: Synthetic polypeptide
  VH of XENP018836

SEQ ID NO: 9304 - protein, 107 aa, Artificial Sequence
  Description of Artificial Sequence: Synthetic polypeptide
  VL of XENP018836
SIVMTQSPATLSVSPGERATLSCRASQSVSNDVAWYQQKPGQSPRLLINYASHRYHGVPDRFTGSGYGTEFTLTISSLQSEDFAVYFCQQDYSSPRTFGGGTKVEIK

SEQ ID NO: 9305 - protein, 5 aa, Artificial Sequence
  Description of Artificial Sequence: Synthetic peptide
  XENP018836 vhCDR1
NYWMN

SEQ ID NO: 9306 - protein, 19 aa, Artificial Sequence
  Description of Artificial Sequence: Synthetic peptide
  XENP018836 vhCDR2
EIRLKSNNYATHYAEPVKG

SEQ ID NO: 9307 - protein, 11 aa, Artificial Sequence
  Description of Artificial Sequence: Synthetic peptide
  XENP018836 vhCDR3
YYGNYGGYFDV

SEQ ID NO: 9308 - protein, 11 aa, Artificial Sequence
  Description of Artificial Sequence: Synthetic peptide
  XENP018836 vlCDR1
RASQSVSNDVA

SEQ ID NO: 9309 - protein, 7 aa, Artificial Sequence
  Description of Artificial Sequence: Synthetic peptide
  XENP018836 vlCDR2
YASHRYH

SEQ ID NO: 9310 - protein, 9 aa, Artificial Sequence
  Description of Artificial Sequence: Synthetic peptide
  XENP018836 vlCDR3
QQDYSSPRT

SEQ ID NO: 9311 - protein, 249 aa, Artificial Sequence
  Description of Artificial Sequence: Synthetic polypeptide
  XENP018837 1G6_H1_L1.91_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYDGVPDRFTGSGYGTEFTLTISSLQSEDFAVYFCQQDYSSPRTFGGGTKVEIK

SEQ ID NO: 9312 - protein, 122 aa, Artificial Sequence; identical to SEQ ID NO: 6246
  Description of Artificial Sequence: Synthetic polypeptide
  VH of XENP018837

SEQ ID NO: 9313 - protein, 107 aa, Artificial Sequence
  Description of Artificial Sequence: Synthetic polypeptide
  VL of XENP018837
SIVMTQSPATLSVSPGERATLSCRASQSVSNDVAWYQQKPGQSPRLLINYASHRYDGVPDRFTGSGYGTEFTLTISSLQSEDFAVYFCQQDYSSPRTFGGGTKVEIK

SEQ ID NO: 9314 - protein, 5 aa, Artificial Sequence
  Description of Artificial Sequence: Synthetic peptide
  XENP018837 vhCDR1
NYWMN

SEQ ID NO: 9315 - protein, 19 aa, Artificial Sequence
  Description of Artificial Sequence: Synthetic peptide
  XENP018837 vhCDR2
EIRLKSNNYATHYAEPVKG

SEQ ID NO: 9316 - protein, 11 aa, Artificial Sequence
  Description of Artificial Sequence: Synthetic peptide
  XENP018837 vhCDR3
YYGNYGGYFDV

SEQ ID NO: 9317 - protein, 11 aa, Artificial Sequence
  Description of Artificial Sequence: Synthetic peptide
  XENP018837 vlCDR1
RASQSVSNDVA

SEQ ID NO: 9318 - protein, 7 aa, Artificial Sequence
  Description of Artificial Sequence: Synthetic peptide
  XENP018837 vlCDR2
YASHRYD

SEQ ID NO: 9319 - protein, 9 aa, Artificial Sequence
  Description of Artificial Sequence: Synthetic peptide
  XENP018837 vlCDR3
QQDYSSPRT

SEQ ID NO: 9320 - protein, 249 aa, Artificial Sequence
  Description of Artificial Sequence: Synthetic polypeptide
  XENP018838 1G6_H1_L1.92_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYKGVPDRFTGSGYGTEFTLTISSLQSEDFAVYFCQQDYSSPRTFGGGTKVEIK

SEQ ID NO: 9321 - protein, 122 aa, Artificial Sequence; identical to SEQ ID NO: 6246
  Description of Artificial Sequence: Synthetic polypeptide
  VH of XENP018838

SEQ ID NO: 9322 - protein, 107 aa, Artificial Sequence
  Description of Artificial Sequence: Synthetic polypeptide
  VL of XENP018838
SIVMTQSPATLSVSPGERATLSCRASQSVSNDVAWYQQKPGQSPRLLINYASHRYKGVPDRFTGSGYGTEFTLTISSLQSEDFAVYFCQQDYSSPRTFGGGTKVEIK

SEQ ID NO: 9323 - protein, 5 aa, Artificial Sequence
  Description of Artificial Sequence: Synthetic peptide
  XENP018838 vhCDR1
NYWMN

SEQ ID NO: 9324 - protein, 19 aa, Artificial Sequence
  Description of Artificial Sequence: Synthetic peptide
  XENP018838 vhCDR2
EIRLKSNNYATHYAEPVKG

SEQ ID NO: 9325 - protein, 11 aa, Artificial Sequence
  Description of Artificial Sequence: Synthetic peptide
  XENP018838 vhCDR3
YYGNYGGYFDV

SEQ ID NO: 9326 - protein, 11 aa, Artificial Sequence
  Description of Artificial Sequence: Synthetic peptide
  XENP018838 vlCDR1
RASQSVSNDVA

SEQ ID NO: 9327 - protein, 7 aa, Artificial Sequence
  Description of Artificial Sequence: Synthetic peptide
  XENP018838 vlCDR2
YASHRYK

SEQ ID NO: 9328 - protein, 9 aa, Artificial Sequence
  Description of Artificial Sequence: Synthetic peptide
  XENP018838 vlCDR3
QQDYSSPRT

SEQ ID NO: 9329 - protein, 249 aa, Artificial Sequence
  Description of Artificial Sequence: Synthetic polypeptide
  XENP018839 1G6_H1_L1.93_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYYGVPDRFTGSGYGTEFTLTISSLQSEDFAVYFCQQDYSSPRTFGGGTKVEIK

SEQ ID NO: 9330 - protein, 122 aa, Artificial Sequence; identical to SEQ ID NO: 6246
  Description of Artificial Sequence: Synthetic polypeptide
  VH of XENP018839

SEQ ID NO: 9331 - protein, 107 aa, Artificial Sequence
  Description of Artificial Sequence: Synthetic polypeptide
  VL of XENP018839
SIVMTQSPATLSVSPGERATLSCRASQSVSNDVAWYQQKPGQSPRLLINYASHRYYGVPDRFTGSGYGTEFTLTISSLQSEDFAVYFCQQDYSSPRTFGGGTKVEIK

SEQ ID NO: 9332 - protein, 5 aa, Artificial Sequence
  Description of Artificial Sequence: Synthetic peptide
  XENP018839 vhCDR1
NYWMN

SEQ ID NO: 9333 - protein, 19 aa, Artificial Sequence
  Description of Artificial Sequence: Synthetic peptide
  XENP018839 vhCDR2
EIRLKSNNYATHYAEPVKG

SEQ ID NO: 9334 - protein, 11 aa, Artificial Sequence
  Description of Artificial Sequence: Synthetic peptide
  XENP018839 vhCDR3
YYGNYGGYFDV

SEQ ID NO: 9335 - protein, 11 aa, Artificial Sequence
  Description of Artificial Sequence: Synthetic peptide
  XENP018839 vlCDR1
RASQSVSNDVA

SEQ ID NO: 9336 - protein, 7 aa, Artificial Sequence
  Description of Artificial Sequence: Synthetic peptide
  XENP018839 vlCDR2
YASHRYY

SEQ ID NO: 9337 - protein, 9 aa, Artificial Sequence
  Description of Artificial Sequence: Synthetic peptide
  XENP018839 vlCDR3
QQDYSSPRT

SEQ ID NO: 9338 - protein, 249 aa, Artificial Sequence
  Description of Artificial Sequence: Synthetic polypeptide
  XENP018840 1G6_H1_L1.94_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTSVPDRFTGSGYGTEFTLTISSLQSEDFAVYFCQQDYSSPRTFGGGTKVEIK

SEQ ID NO: 9339 - protein, 122 aa, Artificial Sequence; identical to SEQ ID NO: 6246
  Description of Artificial Sequence: Synthetic polypeptide
  VH of XENP018840

SEQ ID NO: 9340 - protein, 107 aa, Artificial Sequence
  Description of Artificial Sequence: Synthetic polypeptide
  VL of XENP018840
SIVMTQSPATLSVSPGERATLSCRASQSVSNDVAWYQQKPGQSPRLLINYASHRYTSVPDRFTGSGYGTEFTLTISSLQSEDFAVYFCQQDYSSPRTFGGGTKVEIK

SEQ ID NO: 9341 - protein, 5 aa, Artificial Sequence
  Description of Artificial Sequence: Synthetic peptide
  XENP018840 vhCDR1
NYWMN

SEQ ID NO: 9342 - protein, 19 aa, Artificial Sequence
  Description of Artificial Sequence: Synthetic peptide
  XENP018840 vhCDR2
EIRLKSNNYATHYAEPVKG

SEQ ID NO: 9343 - protein, 11 aa, Artificial Sequence
  Description of Artificial Sequence: Synthetic peptide
  XENP018840 vhCDR3
YYGNYGGYFDV

SEQ ID NO: 9344 - protein, 11 aa, Artificial Sequence
  Description of Artificial Sequence: Synthetic peptide
  XENP018840 vlCDR1
RASQSVSNDVA

SEQ ID NO: 9345 - protein, 7 aa, Artificial Sequence
  Description of Artificial Sequence: Synthetic peptide
  XENP018840 vlCDR2
YASHRYT

SEQ ID NO: 9346 - protein, 9 aa, Artificial Sequence
  Description of Artificial Sequence: Synthetic peptide
  XENP018840 vlCDR3
QQDYSSPRT

SEQ ID NO: 9347 - protein, 249 aa, Artificial Sequence
  Description of Artificial Sequence: Synthetic polypeptide
  XENP018841 1G6_H1_L1.95_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGIPDRFTGSGYGTEFTLTISSLQSEDFAVYFCQQDYSSPRTFGGGTKVEIK

SEQ ID NO: 9348 - protein, 122 aa, Artificial Sequence; identical to SEQ ID NO: 6246
  Description of Artificial Sequence: Synthetic polypeptide
  VH of XENP018841

SEQ ID NO: 9349 - protein, 107 aa, Artificial Sequence
  Description of Artificial Sequence: Synthetic polypeptide
  VL of XENP018841
SIVMTQSPATLSVSPGERATLSCRASQSVSNDVAWYQQKPGQSPRLLINYASHRYTGIPDRFTGSGYGTEFTLTISSLQSEDFAVYFCQQDYSSPRTFGGGTKVEIK

SEQ ID NO: 9350 - protein, 5 aa, Artificial Sequence
  Description of Artificial Sequence: Synthetic peptide
  XENP018841 vhCDR1
NYWMN

SEQ ID NO: 9351 - protein, 19 aa, Artificial Sequence
  Description of Artificial Sequence: Synthetic peptide
  XENP018841 vhCDR2
EIRLKSNNYATHYAEPVKG

SEQ ID NO: 9352 - protein, 11 aa, Artificial Sequence
  Description of Artificial Sequence: Synthetic peptide
  XENP018841 vhCDR3
YYGNYGGYFDV

SEQ ID NO: 9353 - protein, 11 aa, Artificial Sequence
  Description of Artificial Sequence: Synthetic peptide
  XENP018841 vlCDR1
RASQSVSNDVA

SEQ ID NO: 9354 - protein, 7 aa, Artificial Sequence
  Description of Artificial Sequence: Synthetic peptide
  XENP018841 vlCDR2
YASHRYT

SEQ ID NO: 9355 - protein, 9 aa, Artificial Sequence
  Description of Artificial Sequence: Synthetic peptide
  XENP018841 vlCDR3
QQDYSSPRT

SEQ ID NO: 9356 - protein, 249 aa, Artificial Sequence
  Description of Artificial Sequence: Synthetic polypeptide
  XENP018842 1G6_H1_L1.96_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPARFTGSGYGTEFTLTISSLQSEDFAVYFCQQDYSSPRTFGGGTKVEIK

SEQ ID NO: 9357 - protein, 122 aa, Artificial Sequence; identical to SEQ ID NO: 6246
  Description of Artificial Sequence: Synthetic polypeptide
  VH of XENP018842

SEQ ID NO: 9358 - protein, 107 aa, Artificial Sequence
  Description of Artificial Sequence: Synthetic polypeptide
  VL of XENP018842
SIVMTQSPATLSVSPGERATLSCRASQSVSNDVAWYQQKPGQSPRLLINYASHRYTGVPARFTGSGYGTEFTLTISSLQSEDFAVYFCQQDYSSPRTFGGGTKVEIK

SEQ ID NO: 9359 - protein, 5 aa, Artificial Sequence
  Description of Artificial Sequence: Synthetic peptide
  XENP018842 vhCDR1
NYWMN

SEQ ID NO: 9360 - protein, 19 aa, Artificial Sequence
  Description of Artificial Sequence: Synthetic peptide
  XENP018842 vhCDR2
EIRLKSNNYATHYAEPVKG

SEQ ID NO: 9361 - protein, 11 aa, Artificial Sequence
  Description of Artificial Sequence: Synthetic peptide
  XENP018842 vhCDR3
YYGNYGGYFDV

SEQ ID NO: 9362 - protein, 11 aa, Artificial Sequence
  Description of Artificial Sequence: Synthetic peptide
  XENP018842 vlCDR1
RASQSVSNDVA

SEQ ID NO: 9363 - protein, 7 aa, Artificial Sequence
  Description of Artificial Sequence: Synthetic peptide
  XENP018842 vlCDR2
YASHRYT

SEQ ID NO: 9364 - protein, 9 aa, Artificial Sequence
  Description of Artificial Sequence: Synthetic peptide
  XENP018842 vlCDR3
QQDYSSPRT

SEQ ID NO: 9365 - protein, 249 aa, Artificial Sequence
  Description of Artificial Sequence: Synthetic polypeptide
  XENP018843 1G6_H1_L1.97_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFSGSGYGTEFTLTISSLQSEDFAVYFCQQDYSSPRTFGGGTKVEIK

SEQ ID NO: 9366 - protein, 122 aa, Artificial Sequence; identical to SEQ ID NO: 6246
  Description of Artificial Sequence: Synthetic polypeptide
  VH of XENP018843

SEQ ID NO: 9367 - protein, 107 aa, Artificial Sequence
  Description of Artificial Sequence: Synthetic polypeptide
  VL of XENP018843
SIVMTQSPATLSVSPGERATLSCRASQSVSNDVAWYQQKPGQSPRLLINYASHRYTGVPDRFSGSGYGTEFTLTISSLQSEDFAVYFCQQDYSSPRTFGGGTKVEIK

SEQ ID NO: 9368 - protein, 5 aa, Artificial Sequence
  Description of Artificial Sequence: Synthetic peptide
  XENP018843 vhCDR1
NYWMN

SEQ ID NO: 9369 - protein, 19 aa, Artificial Sequence
  Description of Artificial Sequence: Synthetic peptide
  XENP018843 vhCDR2
EIRLKSNNYATHYAEPVKG

SEQ ID NO: 9370 - protein, 11 aa, Artificial Sequence
  Description of Artificial Sequence: Synthetic peptide
  XENP018843 vhCDR3
YYGNYGGYFDV

SEQ ID NO: 9371 - protein, 11 aa, Artificial Sequence
  Description of Artificial Sequence: Synthetic peptide
  XENP018843 vlCDR1
RASQSVSNDVA

SEQ ID NO: 9372 - protein, 7 aa, Artificial Sequence
  Description of Artificial Sequence: Synthetic peptide
  XENP018843 vlCDR2
YASHRYT

SEQ ID NO: 9373 - protein, 9 aa, Artificial Sequence
  Description of Artificial Sequence: Synthetic peptide
  XENP018843 vlCDR3
QQDYSSPRT

SEQ ID NO: 9374 - protein, 249 aa, Artificial Sequence
  Description of Artificial Sequence: Synthetic polypeptide
  XENP018844 1G6_H1_L1.98_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGSGTEFTLTISSLQSEDFAVYFCQQDYSSPRTFGGGTKVEIK

SEQ ID NO: 9375 - protein, 122 aa, Artificial Sequence; identical to SEQ ID NO: 6246
  Description of Artificial Sequence: Synthetic polypeptide
  VH of XENP018844

SEQ ID NO: 9376 - protein, 107 aa, Artificial Sequence
  Description of Artificial Sequence: Synthetic polypeptide
  VL of XENP018844
SIVMTQSPATLSVSPGERATLSCRASQSVSNDVAWYQQKPGQSPRLLINYASHRYTGVPDRFTGSGSGTEFTLTISSLQSEDFAVYFCQQDYSSPRTFGGGTKVEIK

SEQ ID NO: 9377 - protein, 5 aa, Artificial Sequence
  Description of Artificial Sequence: Synthetic peptide
  XENP018844 vhCDR1
NYWMN

SEQ ID NO: 9378 - protein, 19 aa, Artificial Sequence
  Description of Artificial Sequence: Synthetic peptide
  XENP018844 vhCDR2
EIRLKSNNYATHYAEPVKG

SEQ ID NO: 9379 - protein, 11 aa, Artificial Sequence
  Description of Artificial Sequence: Synthetic peptide
  XENP018844 vhCDR3
YYGNYGGYFDV

SEQ ID NO: 9380 - protein, 11 aa, Artificial Sequence
  Description of Artificial Sequence: Synthetic peptide
  XENP018844 vlCDR1
RASQSVSNDVA

SEQ ID NO: 9381 - protein, 7 aa, Artificial Sequence
  Description of Artificial Sequence: Synthetic peptide
  XENP018844 vlCDR2
YASHRYT

SEQ ID NO: 9382 - protein, 9 aa, Artificial Sequence
  Description of Artificial Sequence: Synthetic peptide
  XENP018844 vlCDR3
QQDYSSPRT

SEQ ID NO: 9383 - protein, 249 aa, Artificial Sequence
  Description of Artificial Sequence: Synthetic polypeptide
  XENP018845 1G6_H1_L1.99_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGPGTEFTLTISSLQSEDFAVYFCQQDYSSPRTFGGGTKVEIK

SEQ ID NO: 9384 - protein, 122 aa, Artificial Sequence; identical to SEQ ID NO: 6246
  Description of Artificial Sequence: Synthetic polypeptide
  VH of XENP018845

SEQ ID NO: 9385 - protein, 107 aa, Artificial Sequence
  Description of Artificial Sequence: Synthetic polypeptide
  VL of XENP018845
SIVMTQSPATLSVSPGERATLSCRASQSVSNDVAWYQQKPGQSPRLLINYASHRYTGVPDRFTGSGPGTEFTLTISSLQSEDFAVYFCQQDYSSPRTFGGGTKVEIK

SEQ ID NO: 9386 - protein, 5 aa, Artificial Sequence
  Description of Artificial Sequence: Synthetic peptide
  XENP018845 vhCDR1
NYWMN

SEQ ID NO: 9387 - protein, 19 aa, Artificial Sequence
  Description of Artificial Sequence: Synthetic peptide
  XENP018845 vhCDR2
EIRLKSNNYATHYAEPVKG

SEQ ID NO: 9388 - protein, 11 aa, Artificial Sequence
  Description of Artificial Sequence: Synthetic peptide
  XENP018845 vhCDR3
YYGNYGGYFDV

SEQ ID NO: 9389 - protein, 11 aa, Artificial Sequence
  Description of Artificial Sequence: Synthetic peptide
  XENP018845 vlCDR1
RASQSVSNDVA

SEQ ID NO: 9390 - protein, 7 aa, Artificial Sequence
  Description of Artificial Sequence: Synthetic peptide
  XENP018845 vlCDR2
YASHRYT

SEQ ID NO: 9391 - protein, 9 aa, Artificial Sequence
  Description of Artificial Sequence: Synthetic peptide
  XENP018845 vlCDR3
QQDYSSPRT

SEQ ID NO: 9392 - protein, 249 aa, Artificial Sequence
  Description of Artificial Sequence: Synthetic polypeptide
  XENP018846 1G6_H1_L1.100_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTDFTLTISSLQSEDFAVYFCQQDYSSPRTFGGGTKVEIK

SEQ ID NO: 9393 - protein, 122 aa, Artificial Sequence; identical to SEQ ID NO: 6246
  Description of Artificial Sequence: Synthetic polypeptide
  VH of XENP018846

SEQ ID NO: 9394 - protein, 107 aa, Artificial Sequence
  Description of Artificial Sequence: Synthetic polypeptide
  VL of XENP018846
SIVMTQSPATLSVSPGERATLSCRASQSVSNDVAWYQQKPGQSPRLLINYASHRYTGVPDRFTGSGYGTDFTLTISSLQSEDFAVYFCQQDYSSPRTFGGGTKVEIK

SEQ ID NO: 9395 - protein, 5 aa, Artificial Sequence
  Description of Artificial Sequence: Synthetic peptide
  XENP018846 vhCDR1
NYWMN

SEQ ID NO: 9396 - protein, 19 aa, Artificial Sequence
  Description of Artificial Sequence: Synthetic peptide
  XENP018846 vhCDR2
EIRLKSNNYATHYAEPVKG

SEQ ID NO: 9397 - protein, 11 aa, Artificial Sequence
  Description of Artificial Sequence: Synthetic peptide
  XENP018846 vhCDR3
YYGNYGGYFDV

SEQ ID NO: 9398 - protein, 11 aa, Artificial Sequence
  Description of Artificial Sequence: Synthetic peptide
  XENP018846 vlCDR1
RASQSVSNDVA

SEQ ID NO: 9399 - protein, 7 aa, Artificial Sequence
  Description of Artificial Sequence: Synthetic peptide
  XENP018846 vlCDR2
YASHRYT

SEQ ID NO: 9400 - protein, 9 aa, Artificial Sequence
  Description of Artificial Sequence: Synthetic peptide
  XENP018846 vlCDR3
QQDYSSPRT

SEQ ID NO: 9401 - protein, 249 aa, Artificial Sequence
  Description of Artificial Sequence: Synthetic polypeptide
  XENP018847 1G6_H1_L1.101_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTFTISSLQSEDFAVYFCQQDYSSPRTFGGGTKVEIK

SEQ ID NO: 9402 - protein, 122 aa, Artificial Sequence; identical to SEQ ID NO: 6246
  Description of Artificial Sequence: Synthetic polypeptide
  VH of XENP018847

SEQ ID NO: 9403 - protein, 107 aa, Artificial Sequence
  Description of Artificial Sequence: Synthetic polypeptide
  VL of XENP018847
SIVMTQSPATLSVSPGERATLSCRASQSVSNDVAWYQQKPGQSPRLLINYASHRYTGVPDRFTGSGYGTEFTFTISSLQSEDFAVYFCQQDYSSPRTFGGGTKVEIK

SEQ ID NO: 9404 - protein, 5 aa, Artificial Sequence
  Description of Artificial Sequence: Synthetic peptide
  XENP018847 vhCDR1
NYWMN

SEQ ID NO: 9405 - protein, 19 aa, Artificial Sequence
  Description of Artificial Sequence: Synthetic peptide
  XENP018847 vhCDR2
EIRLKSNNYATHYAEPVKG

SEQ ID NO: 9406 - protein, 11 aa, Artificial Sequence
  Description of Artificial Sequence: Synthetic peptide
  XENP018847 vhCDR3
YYGNYGGYFDV

SEQ ID NO: 9407 - protein, 11 aa, Artificial Sequence
  Description of Artificial Sequence: Synthetic peptide
  XENP018847 vlCDR1
RASQSVSNDVA

SEQ ID NO: 9408 - protein, 7 aa, Artificial Sequence
  Description of Artificial Sequence: Synthetic peptide
  XENP018847 vlCDR2
YASHRYT

SEQ ID NO: 9409 - protein, 9 aa, Artificial Sequence
  Description of Artificial Sequence: Synthetic peptide
  XENP018847 vlCDR3
QQDYSSPRT

SEQ ID NO: 9410 - protein, 249 aa, Artificial Sequence
  Description of Artificial Sequence: Synthetic polypeptide
  XENP018848 1G6_H1_L1.102_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISTLQSEDFAVYFCQQDYSSPRTFGGGTKVEIK

SEQ ID NO: 9411 - protein, 122 aa, Artificial Sequence; identical to SEQ ID NO: 6246
  Description of Artificial Sequence: Synthetic polypeptide
  VH of XENP018848

SEQ ID NO: 9412 - protein, 107 aa, Artificial Sequence
  Description of Artificial Sequence: Synthetic polypeptide
  VL of XENP018848
SIVMTQSPATLSVSPGERATLSCRASQSVSNDVAWYQQKPGQSPRLLINYASHRYTGVPDRFTGSGYGTEFTLTISTLQSEDFAVYFCQQDYSSPRTFGGGTKVEIK

SEQ ID NO: 9413 - protein, 5 aa, Artificial Sequence
  Description of Artificial Sequence: Synthetic peptide
  XENP018848 vhCDR1
NYWMN

SEQ ID NO: 9414 - protein, 19 aa, Artificial Sequence
  Description of Artificial Sequence: Synthetic peptide
  XENP018848 vhCDR2
EIRLKSNNYATHYAEPVKG

SEQ ID NO: 9415 - protein, 11 aa, Artificial Sequence
  Description of Artificial Sequence: Synthetic peptide
  XENP018848 vhCDR3
YYGNYGGYFDV

SEQ ID NO: 9416 - protein, 11 aa, Artificial Sequence
  Description of Artificial Sequence: Synthetic peptide
  XENP018848 vlCDR1
RASQSVSNDVA

SEQ ID NO: 9417 - protein, 7 aa, Artificial Sequence
  Description of Artificial Sequence: Synthetic peptide
  XENP018848 vlCDR2
YASHRYT

SEQ ID NO: 9418 - protein, 9 aa, Artificial Sequence
  Description of Artificial Sequence: Synthetic peptide
  XENP018848 vlCDR3
QQDYSSPRT

SEQ ID NO: 9419 - protein, 249 aa, Artificial Sequence
  Description of Artificial Sequence: Synthetic polypeptide
  XENP018849 1G6_H1_L1.103_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSVQSEDFAVYFCQQDYSSPRTFGGGTKVEIK

SEQ ID NO: 9420 - protein, 122 aa, Artificial Sequence; identical to SEQ ID NO: 6246
  Description of Artificial Sequence: Synthetic polypeptide
  VH of XENP018849

SEQ ID NO: 9421 - protein, 107 aa, Artificial Sequence
  Description of Artificial Sequence: Synthetic polypeptide
  VL of XENP018849
SIVMTQSPATLSVSPGERATLSCRASQSVSNDVAWYQQKPGQSPRLLINYASHRYTGVPDRFTGSGYGTEFTLTISSVQSEDFAVYFCQQDYSSPRTFGGGTKVEIK

SEQ ID NO: 9422 - protein, 5 aa, Artificial Sequence
  Description of Artificial Sequence: Synthetic peptide
  XENP018849 vhCDR1
NYWMN

SEQ ID NO: 9423 - protein, 19 aa, Artificial Sequence
  Description of Artificial Sequence: Synthetic peptide
  XENP018849 vhCDR2
EIRLKSNNYATHYAEPVKG

SEQ ID NO: 9424 - protein, 11 aa, Artificial Sequence
  Description of Artificial Sequence: Synthetic peptide
  XENP018849 vhCDR3
YYGNYGGYFDV

SEQ ID NO: 9425 - protein, 11 aa, Artificial Sequence
  Description of Artificial Sequence: Synthetic peptide
  XENP018849 vlCDR1
RASQSVSNDVA

SEQ ID NO: 9426 - protein, 7 aa, Artificial Sequence
  Description of Artificial Sequence: Synthetic peptide
  XENP018849 vlCDR2
YASHRYT

SEQ ID NO: 9427 - protein, 9 aa, Artificial Sequence
  Description of Artificial Sequence: Synthetic peptide
  XENP018849 vlCDR3
QQDYSSPRT

SEQ ID NO: 9428 - protein, 249 aa, Artificial Sequence
  Description of Artificial Sequence: Synthetic polypeptide
  XENP018850 1G6_H1_L1.104_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQAEDFAVYFCQQDYSSPRTFGGGTKVEIK

SEQ ID NO: 9429 - protein, 122 aa, Artificial Sequence; identical to SEQ ID NO: 6246
  Description of Artificial Sequence: Synthetic polypeptide
  VH of XENP018850

SEQ ID NO: 9430 - protein, 107 aa, Artificial Sequence
  Description of Artificial Sequence: Synthetic polypeptide
  VL of XENP018850
SIVMTQSPATLSVSPGERATLSCRASQSVSNDVAWYQQKPGQSPRLLINYASHRYTGVPDRFTGSGYGTEFTLTISSLQAEDFAVYFCQQDYSSPRTFGGGTKVEIK

SEQ ID NO: 9431 - protein, 5 aa, Artificial Sequence
  Description of Artificial Sequence: Synthetic peptide
  XENP018850 vhCDR1
NYWMN

SEQ ID NO: 9432 - protein, 19 aa, Artificial Sequence
  Description of Artificial Sequence: Synthetic peptide
  XENP018850 vhCDR2
EIRLKSNNYATHYAEPVKG

SEQ ID NO: 9433 - protein, 11 aa, Artificial Sequence
  Description of Artificial Sequence: Synthetic peptide
  XENP018850 vhCDR3
YYGNYGGYFDV

SEQ ID NO: 9434 - protein, 11 aa, Artificial Sequence
  Description of Artificial Sequence: Synthetic peptide
  XENP018850 vlCDR1
RASQSVSNDVA

SEQ ID NO: 9435 - protein, 7 aa, Artificial Sequence
  Description of Artificial Sequence: Synthetic peptide
  XENP018850 vlCDR2
YASHRYT

SEQ ID NO: 9436 - protein, 9 aa, Artificial Sequence
  Description of Artificial Sequence: Synthetic peptide
  XENP018850 vlCDR3
QQDYSSPRT

SEQ ID NO: 9437 - protein, 249 aa, Artificial Sequence
  Description of Artificial Sequence: Synthetic polypeptide
  XENP018851 1G6_H1_L1.105_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDLAVYFCQQDYSSPRTFGGGTKVEIK

SEQ ID NO: 9438 - protein, 122 aa, Artificial Sequence; identical to SEQ ID NO: 6246
  Description of Artificial Sequence: Synthetic polypeptide
  VH of XENP018851

SEQ ID NO: 9439 - protein, 107 aa, Artificial Sequence
  Description of Artificial Sequence: Synthetic polypeptide
  VL of XENP018851
SIVMTQSPATLSVSPGERATLSCRASQSVSNDVAWYQQKPGQSPRLLINYASHRYTGVPDRFTGSGYGTEFTLTISSLQSEDLAVYFCQQDYSSPRTFGGGTKVEIK

SEQ ID NO: 9440 - protein, 5 aa, Artificial Sequence
  Description of Artificial Sequence: Synthetic peptide
  XENP018851 vhCDR1
NYWMN

SEQ ID NO: 9441 - protein, 19 aa, Artificial Sequence
  Description of Artificial Sequence: Synthetic peptide
  XENP018851 vhCDR2
EIRLKSNNYATHYAEPVKG

SEQ ID NO: 9442 - protein, 11 aa, Artificial Sequence
  Description of Artificial Sequence: Synthetic peptide
  XENP018851 vhCDR3
YYGNYGGYFDV

SEQ ID NO: 9443 - protein, 11 aa, Artificial Sequence
  Description of Artificial Sequence: Synthetic peptide
  XENP018851 vlCDR1
RASQSVSNDVA

SEQ ID NO: 9444 - protein, 7 aa, Artificial Sequence
  Description of Artificial Sequence: Synthetic peptide
  XENP018851 vlCDR2
YASHRYT

SEQ ID NO: 9445 - protein, 9 aa, Artificial Sequence
  Description of Artificial Sequence: Synthetic peptide
  XENP018851 vlCDR3
QQDYSSPRT

SEQ ID NO: 9446 - protein, 249 aa, Artificial Sequence
  Description of Artificial Sequence: Synthetic polypeptide
  XENP018852 1G6_H1_L1.106_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYYCQQDYSSPRTFGGGTKVEIK

SEQ ID NO: 9447 - protein, 122 aa, Artificial Sequence; identical to SEQ ID NO: 6246
  Description of Artificial Sequence: Synthetic polypeptide
  VH of XENP018852

SEQ ID NO: 9448 - protein, 107 aa, Artificial Sequence
  Description of Artificial Sequence: Synthetic polypeptide
  VL of XENP018852
SIVMTQSPATLSVSPGERATLSCRASQSVSNDVAWYQQKPGQSPRLLINYASHRYTGVPDRFTGSGYGTEFTLTISSLQSEDFAVYYCQQDYSSPRTFGGGTKVEIK

SEQ ID NO: 9449 - protein, 5 aa, Artificial Sequence
  Description of Artificial Sequence: Synthetic peptide
  XENP018852 vhCDR1
NYWMN

SEQ ID NO: 9450 - protein, 19 aa, Artificial Sequence
  Description of Artificial Sequence: Synthetic peptide
  XENP018852 vhCDR2
EIRLKSNNYATHYAEPVKG

SEQ ID NO: 9451 - protein, 11 aa, Artificial Sequence
  Description of Artificial Sequence: Synthetic peptide
  XENP018852 vhCDR3
YYGNYGGYFDV

SEQ ID NO: 9452 - protein, 11 aa, Artificial Sequence
  Description of Artificial Sequence: Synthetic peptide
  XENP018852 vlCDR1
RASQSVSNDVA

SEQ ID NO: 9453 - protein, 7 aa, Artificial Sequence
  Description of Artificial Sequence: Synthetic peptide
  XENP018852 vlCDR2
YASHRYT

SEQ ID NO: 9454 - protein, 9 aa, Artificial Sequence
  Description of Artificial Sequence: Synthetic peptide
  XENP018852 vlCDR3
QQDYSSPRT

SEQ ID NO: 9455 - protein, 249 aa, Artificial Sequence
  Description of Artificial Sequence: Synthetic polypeptide
  XENP018853 1G6_H1_L1.107_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQQYSSPRTFGGGTKVEIK

SEQ ID NO: 9456 - protein, 122 aa, Artificial Sequence; identical to SEQ ID NO: 6246
  Description of Artificial Sequence: Synthetic polypeptide
  VH of XENP018853

SEQ ID NO: 9457 - protein, 107 aa, Artificial Sequence
  Description of Artificial Sequence: Synthetic polypeptide
  VL of XENP018853
SIVMTQSPATLSVSPGERATLSCRASQSVSNDVAWYQQKPGQSPRLLINYASHRYTGVPDRFTGSGYGTEFTLTISSLQSEDFAVYFCQQQYSSPRTFGGGTKVEIK

SEQ ID NO: 9458 - protein, 5 aa, Artificial Sequence
  Description of Artificial Sequence: Synthetic peptide
  XENP018853 vhCDR1
NYWMN

SEQ ID NO: 9459 - protein, 19 aa, Artificial Sequence
  Description of Artificial Sequence: Synthetic peptide
  XENP018853 vhCDR2
EIRLKSNNYATHYAEPVKG

SEQ ID NO: 9460 - protein, 11 aa, Artificial Sequence
  Description of Artificial Sequence: Synthetic peptide
  XENP018853 vhCDR3
YYGNYGGYFDV

SEQ ID NO: 9461 - protein, 11 aa, Artificial Sequence
  Description of Artificial Sequence: Synthetic peptide
  XENP018853 vlCDR1
RASQSVSNDVA

SEQ ID NO: 9462 - protein, 7 aa, Artificial Sequence
  Description of Artificial Sequence: Synthetic peptide
  XENP018853 vlCDR2
YASHRYT

SEQ ID NO: 9463 - protein, 9 aa, Artificial Sequence
  Description of Artificial Sequence: Synthetic peptide
  XENP018853 vlCDR3
QQQYSSPRT

SEQ ID NO: 9464 - protein, 249 aa, Artificial Sequence
  Description of Artificial Sequence: Synthetic polypeptide
  XENP018854 1G6_H1_L1.108_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQEYSSPRTFGGGTKVEIK

SEQ ID NO: 9465 - protein, 122 aa, Artificial Sequence; identical to SEQ ID NO: 6246
  Description of Artificial Sequence: Synthetic polypeptide
  VH of XENP018854

SEQ ID NO: 9466 - protein, 107 aa, Artificial Sequence
  Description of Artificial Sequence: Synthetic polypeptide
  VL of XENP018854
SIVMTQSPATLSVSPGERATLSCRASQSVSNDVAWYQQKPGQSPRLLINYASHRYTGVPDRFTGSGYGTEFTLTISSLQSEDFAVYFCQQEYSSPRTFGGGTKVEIK

SEQ ID NO: 9467 - protein, 5 aa, Artificial Sequence
  Description of Artificial Sequence: Synthetic peptide
  XENP018854 vhCDR1
NYWMN

SEQ ID NO: 9468 - protein, 19 aa, Artificial Sequence
  Description of Artificial Sequence: Synthetic peptide
  XENP018854 vhCDR2
EIRLKSNNYATHYAEPVKG

SEQ ID NO: 9469 - protein, 11 aa, Artificial Sequence
  Description of Artificial Sequence: Synthetic peptide
  XENP018854 vhCDR3
YYGNYGGYFDV

SEQ ID NO: 9470 - protein, 11 aa, Artificial Sequence
  Description of Artificial Sequence: Synthetic peptide
  XENP018854 vlCDR1
RASQSVSNDVA

SEQ ID NO: 9471 - protein, 7 aa, Artificial Sequence
  Description of Artificial Sequence: Synthetic peptide
  XENP018854 vlCDR2
YASHRYT

SEQ ID NO: 9472 - protein, 9 aa, Artificial Sequence
  Description of Artificial Sequence: Synthetic peptide
  XENP018854 vlCDR3
QQEYSSPRT

SEQ ID NO: 9473 - protein, 249 aa, Artificial Sequence
  Description of Artificial Sequence: Synthetic polypeptide
  XENP018855 1G6_H1_L1.109_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQHYSSPRTFGGGTKVEIK

SEQ ID NO: 9474 - protein, 122 aa, Artificial Sequence; identical to SEQ ID NO: 6246
  Description of Artificial Sequence: Synthetic polypeptide
  VH of XENP018855

SEQ ID NO: 9475 - protein, 107 aa, Artificial Sequence
  Description of Artificial Sequence: Synthetic polypeptide
  VL of XENP018855
SIVMTQSPATLSVSPGERATLSCRASQSVSNDVAWYQQKPGQSPRLLINYASHRYTGVPDRFTGSGYGTEFTLTISSLQSEDFAVYFCQQHYSSPRTFGGGTKVEIK

SEQ ID NO: 9476 - protein, 5 aa, Artificial Sequence
  Description of Artificial Sequence: Synthetic peptide
  XENP018855 vhCDR1
NYWMN

SEQ ID NO: 9477 - protein, 19 aa, Artificial Sequence
  Description of Artificial Sequence: Synthetic peptide
  XENP018855 vhCDR2
EIRLKSNNYATHYAEPVKG

SEQ ID NO: 9478 - protein, 11 aa, Artificial Sequence
  Description of Artificial Sequence: Synthetic peptide
  XENP018855 vhCDR3
YYGNYGGYFDV

SEQ ID NO: 9479 - protein, 11 aa, Artificial Sequence
  Description of Artificial Sequence: Synthetic peptide
  XENP018855 vlCDR1
RASQSVSNDVA

SEQ ID NO: 9480 - protein, 7 aa, Artificial Sequence
  Description of Artificial Sequence: Synthetic peptide
  XENP018855 vlCDR2
YASHRYT

SEQ ID NO: 9481 - protein, 9 aa, Artificial Sequence
  Description of Artificial Sequence: Synthetic peptide
  XENP018855 vlCDR3
QQHYSSPRT

SEQ ID NO: 9482 - protein, 249 aa, Artificial Sequence
  Description of Artificial Sequence: Synthetic polypeptide
  XENP018856 1G6_H1_L1.110_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQSYSSPRTFGGGTKVEIK

SEQ ID NO: 9483 - protein, 122 aa, Artificial Sequence; identical to SEQ ID NO: 6246
  Description of Artificial Sequence: Synthetic polypeptide
  VH of XENP018856

SEQ ID NO: 9484 - protein, 107 aa, Artificial Sequence
  Description of Artificial Sequence: Synthetic polypeptide
  VL of XENP018856
SIVMTQSPATLSVSPGERATLSCRASQSVSNDVAWYQQKPGQSPRLLINYASHRYTGVPDRFTGSGYGTEFTLTISSLQSEDFAVYFCQQSYSSPRTFGGGTKVEIK

SEQ ID NO: 9485 - protein, 5 aa, Artificial Sequence
  Description of Artificial Sequence: Synthetic peptide
  XENP018856 vhCDR1
NYWMN

SEQ ID NO: 9486 - protein, 19 aa, Artificial Sequence
  Description of Artificial Sequence: Synthetic peptide
  XENP018856 vhCDR2
EIRLKSNNYATHYAEPVKG

SEQ ID NO: 9487 - protein, 11 aa, Artificial Sequence
  Description of Artificial Sequence: Synthetic peptide
  XENP018856 vhCDR3
YYGNYGGYFDV

SEQ ID NO: 9488 - protein, 11 aa, Artificial Sequence
  Description of Artificial Sequence: Synthetic peptide
  XENP018856 vlCDR1
RASQSVSNDVA

SEQ ID NO: 9489 - protein, 7 aa, Artificial Sequence
  Description of Artificial Sequence: Synthetic peptide
  XENP018856 vlCDR2
YASHRYT

SEQ ID NO: 9490 - protein, 9 aa, Artificial Sequence
  Description of Artificial Sequence: Synthetic peptide
  XENP018856 vlCDR3
QQSYSSPRT

SEQ ID NO: 9491 - protein, 249 aa, Artificial Sequence
  Description of Artificial Sequence: Synthetic polypeptide
  XENP018857 1G6_H1_L1.111_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQRYSSPRTFGGGTKVEIK

SEQ ID NO: 9492 - protein, 122 aa, Artificial Sequence; identical to SEQ ID NO: 6246
  Description of Artificial Sequence: Synthetic polypeptide
  VH of XENP018857

SEQ ID NO: 9493 - protein, 107 aa, Artificial Sequence
  Description of Artificial Sequence: Synthetic polypeptide
  VL of XENP018857
SIVMTQSPATLSVSPGERATLSCRASQSVSNDVAWYQQKPGQSPRLLINYASHRYTGVPDRFTGSGYGTEFTLTISSLQSEDFAVYFCQQRYSSPRTFGGGTKVEIK

SEQ ID NO: 9494 - protein, 5 aa, Artificial Sequence
  Description of Artificial Sequence: Synthetic peptide
  XENP018857 vhCDR1
NYWMN

SEQ ID NO: 9495 - protein, 19 aa, Artificial Sequence
  Description of Artificial Sequence: Synthetic peptide
  XENP018857 vhCDR2
EIRLKSNNYATHYAEPVKG

SEQ ID NO: 9496 - protein, 11 aa, Artificial Sequence
  Description of Artificial Sequence: Synthetic peptide
  XENP018857 vhCDR3
YYGNYGGYFDV

SEQ ID NO: 9497 - protein, 11 aa, Artificial Sequence
  Description of Artificial Sequence: Synthetic peptide
  XENP018857 vlCDR1
RASQSVSNDVA

SEQ ID NO: 9498 - protein, 7 aa, Artificial Sequence
  Description of Artificial Sequence: Synthetic peptide
  XENP018857 vlCDR2
YASHRYT

SEQ ID NO: 9499 - protein, 9 aa, Artificial Sequence
  Description of Artificial Sequence: Synthetic peptide
  XENP018857 vlCDR3
QQRYSSPRT

SEQ ID NO: 9500 - protein, 249 aa, Artificial Sequence
  Description of Artificial Sequence: Synthetic polypeptide
  XENP018858 1G6_H1_L1.112_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQLYSSPRTFGGGTKVEIK

SEQ ID NO: 9501 - protein, 122 aa, Artificial Sequence; identical to SEQ ID NO: 6246
  Description of Artificial Sequence: Synthetic polypeptide
  VH of XENP018858

SEQ ID NO: 9502 - protein, 107 aa, Artificial Sequence
  Description of Artificial Sequence: Synthetic polypeptide
  VL of XENP018858
SIVMTQSPATLSVSPGERATLSCRASQSVSNDVAWYQQKPGQSPRLLINYASHRYTGVPDRFTGSGYGTEFTLTISSLQSEDFAVYFCQQLYSSPRTFGGGTKVEIK

SEQ ID NO: 9503 - protein, 5 aa, Artificial Sequence
  Description of Artificial Sequence: Synthetic peptide
  XENP018858 vhCDR1
NYWMN

SEQ ID NO: 9504 - protein, 19 aa, Artificial Sequence
  Description of Artificial Sequence: Synthetic peptide
  XENP018858 vhCDR2
EIRLKSNNYATHYAEPVKG

SEQ ID NO: 9505 - protein, 11 aa, Artificial Sequence
  Description of Artificial Sequence: Synthetic peptide
  XENP018858 vhCDR3
YYGNYGGYFDV

SEQ ID NO: 9506 - protein, 11 aa, Artificial Sequence
  Description of Artificial Sequence: Synthetic peptide
  XENP018858 vlCDR1
RASQSVSNDVA

SEQ ID NO: 9507 - protein, 7 aa, Artificial Sequence
  Description of Artificial Sequence: Synthetic peptide
  XENP018858 vlCDR2
YASHRYT

SEQ ID NO: 9508 - protein, 9 aa, Artificial Sequence
  Description of Artificial Sequence: Synthetic peptide
  XENP018858 vlCDR3
QQLYSSPRT

SEQ ID NO: 9509 - protein, 249 aa, Artificial Sequence
  Description of Artificial Sequence: Synthetic polypeptide
  XENP018859 1G6_H1_L1.113_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQTYSSPRTFGGGTKVEIK

SEQ ID NO: 9510 - protein, 122 aa, Artificial Sequence; identical to SEQ ID NO: 6246
  Description of Artificial Sequence: Synthetic polypeptide
  VH of XENP018859

SEQ ID NO: 9511 - protein, 107 aa, Artificial Sequence
  Description of Artificial Sequence: Synthetic polypeptide
  VL of XENP018859
SIVMTQSPATLSVSPGERATLSCRASQSVSNDVAWYQQKPGQSPRLLINYASHRYTGVPDRFTGSGYGTEFTLTISSLQSEDFAVYFCQQTYSSPRTFGGGTKVEIK

SEQ ID NO: 9512 - protein, 5 aa, Artificial Sequence
  Description of Artificial Sequence: Synthetic peptide
  XENP018859 vhCDR1
NYWMN

SEQ ID NO: 9513 - protein, 19 aa, Artificial Sequence
  Description of Artificial Sequence: Synthetic peptide
  XENP018859 vhCDR2
EIRLKSNNYATHYAEPVKG

SEQ ID NO: 9514 - protein, 11 aa, Artificial Sequence
  Description of Artificial Sequence: Synthetic peptide
  XENP018859 vhCDR3
YYGNYGGYFDV

SEQ ID NO: 9515 - protein, 11 aa, Artificial Sequence
  Description of Artificial Sequence: Synthetic peptide
  XENP018859 vlCDR1
RASQSVSNDVA

SEQ ID NO: 9516 - protein, 7 aa, Artificial Sequence
  Description of Artificial Sequence: Synthetic peptide
  XENP018859 vlCDR2
YASHRYT

SEQ ID NO: 9517 - protein, 9 aa, Artificial Sequence
  Description of Artificial Sequence: Synthetic peptide
  XENP018859 vlCDR3
QQTYSSPRT

SEQ ID NO: 9518 - protein, 249 aa, Artificial Sequence
  Description of Artificial Sequence: Synthetic polypeptide
  XENP018860 1G6_H1_L1.114_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQGYSSPRTFGGGTKVEIK

SEQ ID NO: 9519 - protein, 122 aa, Artificial Sequence; identical to SEQ ID NO: 6246
  Description of Artificial Sequence: Synthetic polypeptide
  VH of XENP018860

SEQ ID NO: 9520 - protein, 107 aa, Artificial Sequence
  Description of Artificial Sequence: Synthetic polypeptide
  VL of XENP018860
SIVMTQSPATLSVSPGERATLSCRASQSVSNDVAWYQQKPGQSPRLLINYASHRYTGVPDRFTGSGYGTEFTLTISSLQSEDFAVYFCQQGYSSPRTFGGGTKVEIK

SEQ ID NO: 9521 - protein, 5 aa, Artificial Sequence
  Description of Artificial Sequence: Synthetic peptide
  XENP018860 vhCDR1
NYWMN

SEQ ID NO: 9522 - protein, 19 aa, Artificial Sequence
  Description of Artificial Sequence: Synthetic peptide
  XENP018860 vhCDR2
EIRLKSNNYATHYAEPVKG

SEQ ID NO: 9523 - protein, 11 aa, Artificial Sequence
  Description of Artificial Sequence: Synthetic peptide
  XENP018860 vhCDR3
YYGNYGGYFDV

SEQ ID NO: 9524 - protein, 11 aa, Artificial Sequence
  Description of Artificial Sequence: Synthetic peptide
  XENP018860 vlCDR1
RASQSVSNDVA

SEQ ID NO: 9525 - protein, 7 aa, Artificial Sequence
  Description of Artificial Sequence: Synthetic peptide
  XENP018860 vlCDR2
YASHRYT

SEQ ID NO: 9526 - protein, 9 aa, Artificial Sequence
  Description of Artificial Sequence: Synthetic peptide
  XENP018860 vlCDR3
QQGYSSPRT

SEQ ID NO: 9527 - protein, 249 aa, Artificial Sequence
  Description of Artificial Sequence: Synthetic polypeptide
  XENP018861 1G6_H1_L1.115_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQYYSSPRTFGGGTKVEIK

SEQ ID NO: 9528 - protein, 122 aa, Artificial Sequence; identical to SEQ ID NO: 6246
  Description of Artificial Sequence: Synthetic polypeptide
  VH of XENP018861

SEQ ID NO: 9529 - protein, 107 aa, Artificial Sequence
  Description of Artificial Sequence: Synthetic polypeptide
  VL of XENP018861
SIVMTQSPATLSVSPGERATLSCRASQSVSNDVAWYQQKPGQSPRLLINYASHRYTGVPDRFTGSGYGTEFTLTISSLQSEDFAVYFCQQYYSSPRTFGGGTKVEIK

SEQ ID NO: 9530 - protein, 5 aa, Artificial Sequence
  Description of Artificial Sequence: Synthetic peptide
  XENP018861 vhCDR1
NYWMN

SEQ ID NO: 9531 - protein, 19 aa, Artificial Sequence
  Description of Artificial Sequence: Synthetic peptide
  XENP018861 vhCDR2
EIRLKSNNYATHYAEPVKG

SEQ ID NO: 9532 - protein, 11 aa, Artificial Sequence
  Description of Artificial Sequence: Synthetic peptide
  XENP018861 vhCDR3
YYGNYGGYFDV

SEQ ID NO: 9533 - protein, 11 aa, Artificial Sequence
  Description of Artificial Sequence: Synthetic peptide
  XENP018861 vlCDR1
RASQSVSNDVA

SEQ ID NO: 9534 - protein, 7 aa, Artificial Sequence
  Description of Artificial Sequence: Synthetic peptide
  XENP018861 vlCDR2
YASHRYT

SEQ ID NO: 9535 - protein, 9 aa, Artificial Sequence
  Description of Artificial Sequence: Synthetic peptide
  XENP018861 vlCDR3
QQYYSSPRT

SEQ ID NO: 9536 - protein, 249 aa, Artificial Sequence
  Description of Artificial Sequence: Synthetic polypeptide
  XENP018862 1G6_H1_L1.116_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDFSSPRTFGGGTKVEIK

SEQ ID NO: 9537 - protein, 122 aa, Artificial Sequence; identical to SEQ ID NO: 6246
  Description of Artificial Sequence: Synthetic polypeptide
  VH of XENP018862

SEQ ID NO: 9538 - protein, 107 aa, Artificial Sequence
  Description of Artificial Sequence: Synthetic polypeptide
  VL of XENP018862
SIVMTQSPATLSVSPGERATLSCRASQSVSNDVAWYQQKPGQSPRLLINYASHRYTGVPDRFTGSGYGTEFTLTISSLQSEDFAVYFCQQDFSSPRTFGGGTKVEIK

SEQ ID NO: 9539 - protein, 5 aa, Artificial Sequence
  Description of Artificial Sequence: Synthetic peptide
  XENP018862 vhCDR1
NYWMN

SEQ ID NO: 9540 - protein, 19 aa, Artificial Sequence
  Description of Artificial Sequence: Synthetic peptide
  XENP018862 vhCDR2
EIRLKSNNYATHYAEPVKG

SEQ ID NO: 9541 - protein, 11 aa, Artificial Sequence
  Description of Artificial Sequence: Synthetic peptide
  XENP018862 vhCDR3
YYGNYGGYFDV

SEQ ID NO: 9542 - protein, 11 aa, Artificial Sequence
  Description of Artificial Sequence: Synthetic peptide
  XENP018862 vlCDR1
RASQSVSNDVA

SEQ ID NO: 9543 - protein, 7 aa, Artificial Sequence
  Description of Artificial Sequence: Synthetic peptide
  XENP018862 vlCDR2
YASHRYT

SEQ ID NO: 9544 - protein, 9 aa, Artificial Sequence
  Description of Artificial Sequence: Synthetic peptide
  XENP018862 vlCDR3
QQDFSSPRT

SEQ ID NO: 9545 - protein, 249 aa, Artificial Sequence
  Description of Artificial Sequence: Synthetic polypeptide
  XENP018863 1G6_H1_L1.117_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDHSSPRTFGGGTKVEIK

SEQ ID NO: 9546 - protein, 122 aa, Artificial Sequence; identical to SEQ ID NO: 6246
  Description of Artificial Sequence: Synthetic polypeptide
  VH of XENP018863

SEQ ID NO: 9547 - protein, 107 aa, Artificial Sequence
  Description of Artificial Sequence: Synthetic polypeptide
  VL of XENP018863
SIVMTQSPATLSVSPGERATLSCRASQSVSNDVAWYQQKPGQSPRLLINYASHRYTGVPDRFTGSGYGTEFTLTISSLQSEDFAVYFCQQDHSSPRTFGGGTKVEIK

SEQ ID NO: 9548 - protein, 5 aa, Artificial Sequence
  Description of Artificial Sequence: Synthetic peptide
  XENP018863 vhCDR1
NYWMN

SEQ ID NO: 9549 - protein, 19 aa, Artificial Sequence
  Description of Artificial Sequence: Synthetic peptide
  XENP018863 vhCDR2
EIRLKSNNYATHYAEPVKG

SEQ ID NO: 9550 - protein, 11 aa, Artificial Sequence
  Description of Artificial Sequence: Synthetic peptide
  XENP018863 vhCDR3
YYGNYGGYFDV

SEQ ID NO: 9551 - protein, 11 aa, Artificial Sequence
  Description of Artificial Sequence: Synthetic peptide
  XENP018863 vlCDR1
RASQSVSNDVA

SEQ ID NO: 9552 - protein, 7 aa, Artificial Sequence
  Description of Artificial Sequence: Synthetic peptide
  XENP018863 vlCDR2
YASHRYT

SEQ ID NO: 9553 - protein, 9 aa, Artificial Sequence
  Description of Artificial Sequence: Synthetic peptide
  XENP018863 vlCDR3
QQDHSSPRT

SEQ ID NO: 9554 - protein, 249 aa, Artificial Sequence
  Description of Artificial Sequence: Synthetic polypeptide
  XENP018864 1G6_H1_L1.118_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDLSSPRTFGGGTKVEIK

SEQ ID NO: 9555 - protein, 122 aa, Artificial Sequence; identical to SEQ ID NO: 6246
  Description of Artificial Sequence: Synthetic polypeptide
  VH of XENP018864

SEQ ID NO: 9556 - protein, 107 aa, Artificial Sequence
  Description of Artificial Sequence: Synthetic polypeptide
  VL of XENP018864
SIVMTQSPATLSVSPGERATLSCRASQSVSNDVAWYQQKPGQSPRLLINYASHRYTGVPDRFTGSGYGTEFTLTISSLQSEDFAVYFCQQDLSSPRTFGGGTKVEIK

SEQ ID NO: 9557 - protein, 5 aa, Artificial Sequence
  Description of Artificial Sequence: Synthetic peptide
  XENP018864 vhCDR1
NYWMN

SEQ ID NO: 9558 - protein, 19 aa, Artificial Sequence
  Description of Artificial Sequence: Synthetic peptide
  XENP018864 vhCDR2
EIRLKSNNYATHYAEPVKG

SEQ ID NO: 9559 - protein, 11 aa, Artificial Sequence
  Description of Artificial Sequence: Synthetic peptide
  XENP018864 vhCDR3
YYGNYGGYFDV

SEQ ID NO: 9560 - protein, 11 aa, Artificial Sequence
  Description of Artificial Sequence: Synthetic peptide
  XENP018864 vlCDR1
RASQSVSNDVA

SEQ ID NO: 9561 - protein, 7 aa, Artificial Sequence
  Description of Artificial Sequence: Synthetic peptide
  XENP018864 vlCDR2
YASHRYT

SEQ ID NO: 9562 - protein, 9 aa, Artificial Sequence
  Description of Artificial Sequence: Synthetic peptide
  XENP018864 vlCDR3
QQDLSSPRT

SEQ ID NO: 9563 - protein, 249 aa, Artificial Sequence
  Description of Artificial Sequence: Synthetic polypeptide
  XENP018865 1G6_H1_L1.119_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDWSSPRTFGGGTKVEIK

SEQ ID NO: 9564 - protein, 122 aa, Artificial Sequence; identical to SEQ ID NO: 6246
  Description of Artificial Sequence: Synthetic polypeptide
  VH of XENP018865

SEQ ID NO: 9565 - protein, 107 aa, Artificial Sequence
  Description of Artificial Sequence: Synthetic polypeptide
  VL of XENP018865
SIVMTQSPATLSVSPGERATLSCRASQSVSNDVAWYQQKPGQSPRLLINYASHRYTGVPDRFTGSGYGTEFTLTISSLQSEDFAVYFCQQDWSSPRTFGGGTKVEIK

SEQ ID NO: 9566 - protein, 5 aa, Artificial Sequence
  Description of Artificial Sequence: Synthetic peptide
  XENP018865 vhCDR1
NYWMN

SEQ ID NO: 9567 - protein, 19 aa, Artificial Sequence
  Description of Artificial Sequence: Synthetic peptide
  XENP018865 vhCDR2
EIRLKSNNYATHYAEPVKG

SEQ ID NO: 9568 - protein, 11 aa, Artificial Sequence
  Description of Artificial Sequence: Synthetic peptide
  XENP018865 vhCDR3
YYGNYGGYFDV

SEQ ID NO: 9569 - protein, 11 aa, Artificial Sequence
  Description of Artificial Sequence: Synthetic peptide
  XENP018865 vlCDR1
RASQSVSNDVA

SEQ ID NO: 9570 - protein, 7 aa, Artificial Sequence
  Description of Artificial Sequence: Synthetic peptide
  XENP018865 vlCDR2
YASHRYT

SEQ ID NO: 9571 - protein, 9 aa, Artificial Sequence
  Description of Artificial Sequence: Synthetic peptide
  XENP018865 vlCDR3
QQDWSSPRT

SEQ ID NO: 9572 - protein, 249 aa, Artificial Sequence
  Description of Artificial Sequence: Synthetic polypeptide
  XENP018866 1G6_H1_L1.120_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDVSSPRTFGGGTKVEIK

SEQ ID NO: 9573 - protein, 122 aa, Artificial Sequence; identical to SEQ ID NO: 6246
  Description of Artificial Sequence: Synthetic polypeptide
  VH of XENP018866

SEQ ID NO: 9574 - protein, 107 aa, Artificial Sequence
  Description of Artificial Sequence: Synthetic polypeptide
  VL of XENP018866
SIVMTQSPATLSVSPGERATLSCRASQSVSNDVAWYQQKPGQSPRLLINYASHRYTGVPDRFTGSGYGTEFTLTISSLQSEDFAVYFCQQDVSSPRTFGGGTKVEIK

SEQ ID NO: 9575 - protein, 5 aa, Artificial Sequence
  Description of Artificial Sequence: Synthetic peptide
  XENP018866 vhCDR1
NYWMN

SEQ ID NO: 9576 - protein, 19 aa, Artificial Sequence
  Description of Artificial Sequence: Synthetic peptide
  XENP018866 vhCDR2
EIRLKSNNYATHYAEPVKG

SEQ ID NO: 9577 - protein, 11 aa, Artificial Sequence
  Description of Artificial Sequence: Synthetic peptide
  XENP018866 vhCDR3
YYGNYGGYFDV

SEQ ID NO: 9578 - protein, 11 aa, Artificial Sequence
  Description of Artificial Sequence: Synthetic peptide
  XENP018866 vlCDR1
RASQSVSNDVA

SEQ ID NO: 9579 - protein, 7 aa, Artificial Sequence
  Description of Artificial Sequence: Synthetic peptide
  XENP018866 vlCDR2
YASHRYT

SEQ ID NO: 9580 - protein, 9 aa, Artificial Sequence
  Description of Artificial Sequence: Synthetic peptide
  XENP018866 vlCDR3
QQDVSSPRT

SEQ ID NO: 9581 - protein, 249 aa, Artificial Sequence
  Description of Artificial Sequence: Synthetic polypeptide
  XENP018867 1G6_H1_L1.121_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDASSPRTFGGGTKVEIK

SEQ ID NO: 9582 - protein, 122 aa, Artificial Sequence; identical to SEQ ID NO: 6246
  Description of Artificial Sequence: Synthetic polypeptide
  VH of XENP018867

SEQ ID NO: 9583 - protein, 107 aa, Artificial Sequence
  Description of Artificial Sequence: Synthetic polypeptide
  VL of XENP018867
SIVMTQSPATLSVSPGERATLSCRASQSVSNDVAWYQQKPGQSPRLLINYASHRYTGVPDRFTGSGYGTEFTLTISSLQSEDFAVYFCQQDASSPRTFGGGTKVEIK

SEQ ID NO: 9584 - protein, 5 aa, Artificial Sequence
  Description of Artificial Sequence: Synthetic peptide
  XENP018867 vhCDR1
NYWMN

SEQ ID NO: 9585 - protein, 19 aa, Artificial Sequence
  Description of Artificial Sequence: Synthetic peptide
  XENP018867 vhCDR2
EIRLKSNNYATHYAEPVKG

SEQ ID NO: 9586 - protein, 11 aa, Artificial Sequence
  Description of Artificial Sequence: Synthetic peptide
  XENP018867 vhCDR3
YYGNYGGYFDV

SEQ ID NO: 9587 - protein, 11 aa, Artificial Sequence
  Description of Artificial Sequence: Synthetic peptide
  XENP018867 vlCDR1
RASQSVSNDVA

SEQ ID NO: 9588 - protein, 7 aa, Artificial Sequence
  Description of Artificial Sequence: Synthetic peptide
  XENP018867 vlCDR2
YASHRYT

SEQ ID NO: 9589 - protein, 9 aa, Artificial Sequence
  Description of Artificial Sequence: Synthetic peptide
  XENP018867 vlCDR3
QQDASSPRT

SEQ ID NO: 9590 - protein, 249 aa, Artificial Sequence
  Description of Artificial Sequence: Synthetic polypeptide
  XENP018868 1G6_H1_L1.122_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDQSSPRTFGGGTKVEIK

SEQ ID NO: 9591 - protein, 122 aa, Artificial Sequence; identical to SEQ ID NO: 6246
  Description of Artificial Sequence: Synthetic polypeptide
  VH of XENP018868

SEQ ID NO: 9592 - protein, 107 aa, Artificial Sequence
  Description of Artificial Sequence: Synthetic polypeptide
  VL of XENP018868
SIVMTQSPATLSVSPGERATLSCRASQSVSNDVAWYQQKPGQSPRLLINYASHRYTGVPDRFTGSGYGTEFTLTISSLQSEDFAVYFCQQDQSSPRTFGGGTKVEIK

SEQ ID NO: 9593 - protein, 5 aa, Artificial Sequence
  Description of Artificial Sequence: Synthetic peptide
  XENP018868 vhCDR1
NYWMN

SEQ ID NO: 9594 - protein, 19 aa, Artificial Sequence
  Description of Artificial Sequence: Synthetic peptide
  XENP018868 vhCDR2
EIRLKSNNYATHYAEPVKG

SEQ ID NO: 9595 - protein, 11 aa, Artificial Sequence
  Description of Artificial Sequence: Synthetic peptide
  XENP018868 vhCDR3
YYGNYGGYFDV

SEQ ID NO: 9596 - protein, 11 aa, Artificial Sequence
  Description of Artificial Sequence: Synthetic peptide
  XENP018868 vlCDR1
RASQSVSNDVA

SEQ ID NO: 9597 - protein, 7 aa, Artificial Sequence
  Description of Artificial Sequence: Synthetic peptide
  XENP018868 vlCDR2
YASHRYT

SEQ ID NO: 9598 - protein, 9 aa, Artificial Sequence
  Description of Artificial Sequence: Synthetic peptide
  XENP018868 vlCDR3
QQDQSSPRT

SEQ ID NO: 9599 - protein, 249 aa, Artificial Sequence
  Description of Artificial Sequence: Synthetic polypeptide
  XENP018869 1G6_H1_L1.123_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDDSSPRTFGGGTKVEIK

SEQ ID NO: 9600 - protein, 122 aa, Artificial Sequence; identical to SEQ ID NO: 6246
  Description of Artificial Sequence: Synthetic polypeptide
  VH of XENP018869

SEQ ID NO: 9601 - protein, 107 aa, Artificial Sequence
  Description of Artificial Sequence: Synthetic polypeptide
  VL of XENP018869
SIVMTQSPATLSVSPGERATLSCRASQSVSNDVAWYQQKPGQSPRLLINYASHRYTGVPDRFTGSGYGTEFTLTISSLQSEDFAVYFCQQDDSSPRTFGGGTKVEIK

SEQ ID NO: 9602 - protein, 5 aa, Artificial Sequence
  Description of Artificial Sequence: Synthetic peptide
  XENP018869 vhCDR1
NYWMN

SEQ ID NO: 9603 - protein, 19 aa, Artificial Sequence
  Description of Artificial Sequence: Synthetic peptide
  XENP018869 vhCDR2
EIRLKSNNYATHYAEPVKG

SEQ ID NO: 9604 - protein, 11 aa, Artificial Sequence
  Description of Artificial Sequence: Synthetic peptide
  XENP018869 vhCDR3
YYGNYGGYFDV

SEQ ID NO: 9605 - protein, 11 aa, Artificial Sequence
  Description of Artificial Sequence: Synthetic peptide
  XENP018869 vlCDR1
RASQSVSNDVA

SEQ ID NO: 9606 - protein, 7 aa, Artificial Sequence
  Description of Artificial Sequence: Synthetic peptide
  XENP018869 vlCDR2
YASHRYT

SEQ ID NO: 9607 - protein, 9 aa, Artificial Sequence
  Description of Artificial Sequence: Synthetic peptide
  XENP018869 vlCDR3
QQDDSSPRT

SEQ ID NO: 9608 - protein, 249 aa, Artificial Sequence
  Description of Artificial Sequence: Synthetic polypeptide
  XENP018870 1G6_H1_L1.124_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDKSSPRTFGGGTKVEIK

SEQ ID NO: 9609 - protein, 122 aa, Artificial Sequence; identical to SEQ ID NO: 6246
  Description of Artificial Sequence: Synthetic polypeptide
  VH of XENP018870

SEQ ID NO: 9610 - protein, 107 aa, Artificial Sequence
  Description of Artificial Sequence: Synthetic polypeptide
  VL of XENP018870
SIVMTQSPATLSVSPGERATLSCRASQSVSNDVAWYQQKPGQSPRLLINYASHRYTGVPDRFTGSGYGTEFTLTISSLQSEDFAVYFCQQDKSSPRTFGGGTKVEIK

SEQ ID NO: 9611 - protein, 5 aa, Artificial Sequence
  Description of Artificial Sequence: Synthetic peptide
  XENP018870 vhCDR1
NYWMN

SEQ ID NO: 9612 - protein, 19 aa, Artificial Sequence
  Description of Artificial Sequence: Synthetic peptide
  XENP018870 vhCDR2
EIRLKSNNYATHYAEPVKG

SEQ ID NO: 9613 - protein, 11 aa, Artificial Sequence
  Description of Artificial Sequence: Synthetic peptide
  XENP018870 vhCDR3
YYGNYGGYFDV

SEQ ID NO: 9614 - protein, 11 aa, Artificial Sequence
  Description of Artificial Sequence: Synthetic peptide
  XENP018870 vlCDR1
RASQSVSNDVA

SEQ ID NO: 9615 - protein, 7 aa, Artificial Sequence
  Description of Artificial Sequence: Synthetic peptide
  XENP018870 vlCDR2
YASHRYT

SEQ ID NO: 9616 - protein, 9 aa, Artificial Sequence
  Description of Artificial Sequence: Synthetic peptide
  XENP018870 vlCDR3
QQDKSSPRT

SEQ ID NO: 9617 - protein, 249 aa, Artificial Sequence
  Description of Artificial Sequence: Synthetic polypeptide
  XENP018871 1G6_H1_L1.125_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDSSSPRTFGGGTKVEIK

SEQ ID NO: 9618 - protein, 122 aa, Artificial Sequence; identical to SEQ ID NO: 6246
  Description of Artificial Sequence: Synthetic polypeptide
  VH of XENP018871

SEQ ID NO: 9619 - protein, 107 aa, Artificial Sequence
  Description of Artificial Sequence: Synthetic polypeptide
  VL of XENP018871
SIVMTQSPATLSVSPGERATLSCRASQSVSNDVAWYQQKPGQSPRLLINYASHRYTGVPDRFTGSGYGTEFTLTISSLQSEDFAVYFCQQDSSSPRTFGGGTKVEIK

SEQ ID NO: 9620 - protein, 5 aa, Artificial Sequence
  Description of Artificial Sequence: Synthetic peptide
  XENP018871 vhCDR1
NYWMN

SEQ ID NO: 9621 - protein, 19 aa, Artificial Sequence
  Description of Artificial Sequence: Synthetic peptide
  XENP018871 vhCDR2
EIRLKSNNYATHYAEPVKG

SEQ ID NO: 9622 - protein, 11 aa, Artificial Sequence
  Description of Artificial Sequence: Synthetic peptide
  XENP018871 vhCDR3
YYGNYGGYFDV

SEQ ID NO: 9623 - protein, 11 aa, Artificial Sequence
  Description of Artificial Sequence: Synthetic peptide
  XENP018871 vlCDR1
RASQSVSNDVA

SEQ ID NO: 9624 - protein, 7 aa, Artificial Sequence
  Description of Artificial Sequence: Synthetic peptide
  XENP018871 vlCDR2
YASHRYT

SEQ ID NO: 9625 - protein, 9 aa, Artificial Sequence
  Description of Artificial Sequence: Synthetic peptide
  XENP018871 vlCDR3
QQDSSSPRT

SEQ ID NO: 9626 - protein, 249 aa, Artificial Sequence
  Description of Artificial Sequence: Synthetic polypeptide
  XENP018872 1G6_H1_L1.126_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDGSSPRTFGGGTKVEIK

SEQ ID NO: 9627 - protein, 122 aa, Artificial Sequence; identical to SEQ ID NO: 6246
  Description of Artificial Sequence: Synthetic polypeptide
  VH of XENP018872

SEQ ID NO: 9628 - protein, 107 aa, Artificial Sequence
  Description of Artificial Sequence: Synthetic polypeptide
  VL of XENP018872
SIVMTQSPATLSVSPGERATLSCRASQSVSNDVAWYQQKPGQSPRLLINYASHRYTGVPDRFTGSGYGTEFTLTISSLQSEDFAVYFCQQDGSSPRTFGGGTKVEIK

SEQ ID NO: 9629 - protein, 5 aa, Artificial Sequence
  Description of Artificial Sequence: Synthetic peptide
  XENP018872 vhCDR1
NYWMN

SEQ ID NO: 9630 - protein, 19 aa, Artificial Sequence
  Description of Artificial Sequence: Synthetic peptide
  XENP018872 vhCDR2
EIRLKSNNYATHYAEPVKG

SEQ ID NO: 9631 - protein, 11 aa, Artificial Sequence
  Description of Artificial Sequence: Synthetic peptide
  XENP018872 vhCDR3
YYGNYGGYFDV

SEQ ID NO: 9632 - protein, 11 aa, Artificial Sequence
  Description of Artificial Sequence: Synthetic peptide
  XENP018872 vlCDR1
RASQSVSNDVA

SEQ ID NO: 9633 - protein, 7 aa, Artificial Sequence
  Description of Artificial Sequence: Synthetic peptide
  XENP018872 vlCDR2
YASHRYT

SEQ ID NO: 9634 - protein, 9 aa, Artificial Sequence
  Description of Artificial Sequence: Synthetic peptide
  XENP018872 vlCDR3
QQDGSSPRT

SEQ ID NO: 9635 - protein, 249 aa, Artificial Sequence
  Description of Artificial Sequence: Synthetic polypeptide
  XENP018873 1G6_H1_L1.127_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYTSPRTFGGGTKVEIK

SEQ ID NO: 9636 - protein, 122 aa, Artificial Sequence; identical to SEQ ID NO: 6246
  Description of Artificial Sequence: Synthetic polypeptide
  VH of XENP018873

SEQ ID NO: 9637 - protein, 107 aa, Artificial Sequence
  Description of Artificial Sequence: Synthetic polypeptide
  VL of XENP018873
SIVMTQSPATLSVSPGERATLSCRASQSVSNDVAWYQQKPGQSPRLLINYASHRYTGVPDRFTGSGYGTEFTLTISSLQSEDFAVYFCQQDYTSPRTFGGGTKVEIK

SEQ ID NO: 9638 - protein, 5 aa, Artificial Sequence
  Description of Artificial Sequence: Synthetic peptide
  XENP018873 vhCDR1
NYWMN

SEQ ID NO: 9639 - protein, 19 aa, Artificial Sequence
  Description of Artificial Sequence: Synthetic peptide
  XENP018873 vhCDR2
EIRLKSNNYATHYAEPVKG

SEQ ID NO: 9640 - protein, 11 aa, Artificial Sequence
  Description of Artificial Sequence: Synthetic peptide
  XENP018873 vhCDR3
YYGNYGGYFDV

SEQ ID NO: 9641 - protein, 11 aa, Artificial Sequence
  Description of Artificial Sequence: Synthetic peptide
  XENP018873 vlCDR1
RASQSVSNDVA

SEQ ID NO: 9642 - protein, 7 aa, Artificial Sequence
  Description of Artificial Sequence: Synthetic peptide
  XENP018873 vlCDR2
YASHRYT

SEQ ID NO: 9643 - protein, 9 aa, Artificial Sequence
  Description of Artificial Sequence: Synthetic peptide
  XENP018873 vlCDR3
QQDYTSPRT

SEQ ID NO: 9644 - protein, 249 aa, Artificial Sequence
  Description of Artificial Sequence: Synthetic polypeptide
  XENP018874 1G6_H1_L1.128_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYASPRTFGGGTKVEIK

SEQ ID NO: 9645 - protein, 122 aa, Artificial Sequence; identical to SEQ ID NO: 6246
  Description of Artificial Sequence: Synthetic polypeptide
  VH of XENP018874

SEQ ID NO: 9646 - protein, 107 aa, Artificial Sequence
  Description of Artificial Sequence: Synthetic polypeptide
  VL of XENP018874
SIVMTQSPATLSVSPGERATLSCRASQSVSNDVAWYQQKPGQSPRLLINYASHRYTGVPDRFTGSGYGTEFTLTISSLQSEDFAVYFCQQDYASPRTFGGGTKVEIK

SEQ ID NO: 9647 - protein, 5 aa, Artificial Sequence
  Description of Artificial Sequence: Synthetic peptide
  XENP018874 vhCDR1
NYWMN

SEQ ID NO: 9648 - protein, 19 aa, Artificial Sequence
  Description of Artificial Sequence: Synthetic peptide
  XENP018874 vhCDR2
EIRLKSNNYATHYAEPVKG

SEQ ID NO: 9649 - protein, 11 aa, Artificial Sequence
  Description of Artificial Sequence: Synthetic peptide
  XENP018874 vhCDR3
YYGNYGGYFDV

SEQ ID NO: 9650 - protein, 11 aa, Artificial Sequence
  Description of Artificial Sequence: Synthetic peptide
  XENP018874 vlCDR1
RASQSVSNDVA

SEQ ID NO: 9651 - protein, 7 aa, Artificial Sequence
  Description of Artificial Sequence: Synthetic peptide
  XENP018874 vlCDR2
YASHRYT

SEQ ID NO: 9652 - protein, 9 aa, Artificial Sequence
  Description of Artificial Sequence: Synthetic peptide
  XENP018874 vlCDR3
QQDYASPRT

SEQ ID NO: 9653 - protein, 249 aa, Artificial Sequence
  Description of Artificial Sequence: Synthetic polypeptide
  XENP018875 1G6_H1_L1.129_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYQSPRTFGGGTKVEIK

SEQ ID NO: 9654 - protein, 122 aa, Artificial Sequence; identical to SEQ ID NO: 6246
  Description of Artificial Sequence: Synthetic polypeptide
  VH of XENP018875

SEQ ID NO: 9655 - protein, 107 aa, Artificial Sequence
  Description of Artificial Sequence: Synthetic polypeptide
  VL of XENP018875
SIVMTQSPATLSVSPGERATLSCRASQSVSNDVAWYQQKPGQSPRLLINYASHRYTGVPDRFTGSGYGTEFTLTISSLQSEDFAVYFCQQDYQSPRTFGGGTKVEIK

SEQ ID NO: 9656 - protein, 5 aa, Artificial Sequence
  Description of Artificial Sequence: Synthetic peptide
  XENP018875 vhCDR1
NYWMN

SEQ ID NO: 9657 - protein, 19 aa, Artificial Sequence
  Description of Artificial Sequence: Synthetic peptide
  XENP018875 vhCDR2
EIRLKSNNYATHYAEPVKG

SEQ ID NO: 9658 - protein, 11 aa, Artificial Sequence
  Description of Artificial Sequence: Synthetic peptide
  XENP018875 vhCDR3
YYGNYGGYFDV

SEQ ID NO: 9659 - protein, 11 aa, Artificial Sequence
  Description of Artificial Sequence: Synthetic peptide
  XENP018875 vlCDR1
RASQSVSNDVA

SEQ ID NO: 9660 - protein, 7 aa, Artificial Sequence
  Description of Artificial Sequence: Synthetic peptide
  XENP018875 vlCDR2
YASHRYT

SEQ ID NO: 9661 - protein, 9 aa, Artificial Sequence
  Description of Artificial Sequence: Synthetic peptide
  XENP018875 vlCDR3
QQDYQSPRT

SEQ ID NO: 9662 - protein, 249 aa, Artificial Sequence
  Description of Artificial Sequence: Synthetic polypeptide
  XENP018876 1G6_H1_L1.130_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYGSPRTFGGGTKVEIK

SEQ ID NO: 9663 - protein, 122 aa, Artificial Sequence; identical to SEQ ID NO: 6246
  Description of Artificial Sequence: Synthetic polypeptide
  VH of XENP018876

SEQ ID NO: 9664 - protein, 107 aa, Artificial Sequence
  Description of Artificial Sequence: Synthetic polypeptide
  VL of XENP018876
SIVMTQSPATLSVSPGERATLSCRASQSVSNDVAWYQQKPGQSPRLLINYASHRYTGVPDRFTGSGYGTEFTLTISSLQSEDFAVYFCQQDYGSPRTFGGGTKVEIK

SEQ ID NO: 9665 - protein, 5 aa, Artificial Sequence
  Description of Artificial Sequence: Synthetic peptide
  XENP018876 vhCDR1
NYWMN

SEQ ID NO: 9666 - protein, 19 aa, Artificial Sequence
  Description of Artificial Sequence: Synthetic peptide
  XENP018876 vhCDR2
EIRLKSNNYATHYAEPVKG

SEQ ID NO: 9667 - protein, 11 aa, Artificial Sequence
  Description of Artificial Sequence: Synthetic peptide
  XENP018876 vhCDR3
YYGNYGGYFDV

SEQ ID NO: 9668 - protein, 11 aa, Artificial Sequence
  Description of Artificial Sequence: Synthetic peptide
  XENP018876 vlCDR1
RASQSVSNDVA

SEQ ID NO: 9669 - protein, 7 aa, Artificial Sequence
  Description of Artificial Sequence: Synthetic peptide
  XENP018876 vlCDR2
YASHRYT

SEQ ID NO: 9670 - protein, 9 aa, Artificial Sequence
  Description of Artificial Sequence: Synthetic peptide
  XENP018876 vlCDR3
QQDYGSPRT

SEQ ID NO: 9671 - protein, 249 aa, Artificial Sequence
  Description of Artificial Sequence: Synthetic polypeptide
  XENP018877 1G6_H1_L1.131_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYVSPRTFGGGTKVEIK

SEQ ID NO: 9672 - protein, 122 aa, Artificial Sequence; identical to SEQ ID NO: 6246
  Description of Artificial Sequence: Synthetic polypeptide
  VH of XENP018877

SEQ ID NO: 9673 - protein, 107 aa, Artificial Sequence
  Description of Artificial Sequence: Synthetic polypeptide
  VL of XENP018877
SIVMTQSPATLSVSPGERATLSCRASQSVSNDVAWYQQKPGQSPRLLINYASHRYTGVPDRFTGSGYGTEFTLTISSLQSEDFAVYFCQQDYVSPRTFGGGTKVEIK

SEQ ID NO: 9674 - protein, 5 aa, Artificial Sequence
  Description of Artificial Sequence: Synthetic peptide
  XENP018877 vhCDR1
NYWMN

SEQ ID NO: 9675 - protein, 19 aa, Artificial Sequence
  Description of Artificial Sequence: Synthetic peptide
  XENP018877 vhCDR2
EIRLKSNNYATHYAEPVKG

SEQ ID NO: 9676 - protein, 11 aa, Artificial Sequence
  Description of Artificial Sequence: Synthetic peptide
  XENP018877 vhCDR3
YYGNYGGYFDV

SEQ ID NO: 9677 - protein, 11 aa, Artificial Sequence
  Description of Artificial Sequence: Synthetic peptide
  XENP018877 vlCDR1
RASQSVSNDVA

SEQ ID NO: 9678 - protein, 7 aa, Artificial Sequence
  Description of Artificial Sequence: Synthetic peptide
  XENP018877 vlCDR2
YASHRYT

SEQ ID NO: 9679 - protein, 9 aa, Artificial Sequence
  Description of Artificial Sequence: Synthetic peptide
  XENP018877 vlCDR3
QQDYVSPRT

SEQ ID NO: 9680 - protein, 249 aa, Artificial Sequence
  Description of Artificial Sequence: Synthetic polypeptide
  XENP018878 1G6_H1_L1.132_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYHSPRTFGGGTKVEIK

SEQ ID NO: 9681 - protein, 122 aa, Artificial Sequence; identical to SEQ ID NO: 6246
  Description of Artificial Sequence: Synthetic polypeptide
  VH of XENP018878

SEQ ID NO: 9682 - protein, 107 aa, Artificial Sequence
  Description of Artificial Sequence: Synthetic polypeptide
  VL of XENP018878
SIVMTQSPATLSVSPGERATLSCRASQSVSNDVAWYQQKPGQSPRLLINYASHRYTGVPDRFTGSGYGTEFTLTISSLQSEDFAVYFCQQDYHSPRTFGGGTKVEIK

SEQ ID NO: 9683 - protein, 5 aa, Artificial Sequence
  Description of Artificial Sequence: Synthetic peptide
  XENP018878 vhCDR1
NYWMN

SEQ ID NO: 9684 - protein, 19 aa, Artificial Sequence
  Description of Artificial Sequence: Synthetic peptide
  XENP018878 vhCDR2
EIRLKSNNYATHYAEPVKG

SEQ ID NO: 9685 - protein, 11 aa, Artificial Sequence
  Description of Artificial Sequence: Synthetic peptide
  XENP018878 vhCDR3
YYGNYGGYFDV

SEQ ID NO: 9686 - protein, 11 aa, Artificial Sequence
  Description of Artificial Sequence: Synthetic peptide
  XENP018878 vlCDR1
RASQSVSNDVA

SEQ ID NO: 9687 - protein, 7 aa, Artificial Sequence
  Description of Artificial Sequence: Synthetic peptide
  XENP018878 vlCDR2
YASHRYT

SEQ ID NO: 9688 - protein, 9 aa, Artificial Sequence
  Description of Artificial Sequence: Synthetic peptide
  XENP018878 vlCDR3
QQDYHSPRT

SEQ ID NO: 9689 - protein, 249 aa, Artificial Sequence
  Description of Artificial Sequence: Synthetic polypeptide
  XENP018879 1G6_H1_L1.133_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYDSPRTFGGGTKVEIK

SEQ ID NO: 9690 - protein, 122 aa, Artificial Sequence; identical to SEQ ID NO: 6246
  Description of Artificial Sequence: Synthetic polypeptide
  VH of XENP018879

SEQ ID NO: 9691 - protein, 107 aa, Artificial Sequence
  Description of Artificial Sequence: Synthetic polypeptide
  VL of XENP018879
SIVMTQSPATLSVSPGERATLSCRASQSVSNDVAWYQQKPGQSPRLLINYASHRYTGVPDRFTGSGYGTEFTLTISSLQSEDFAVYFCQQDYDSPRTFGGGTKVEIK

SEQ ID NO: 9692 - protein, 5 aa, Artificial Sequence
  Description of Artificial Sequence: Synthetic peptide
  XENP018879 vhCDR1
NYWMN

SEQ ID NO: 9693 - protein, 19 aa, Artificial Sequence
  Description of Artificial Sequence: Synthetic peptide
  XENP018879 vhCDR2
EIRLKSNNYATHYAEPVKG

SEQ ID NO: 9694 - protein, 11 aa, Artificial Sequence
  Description of Artificial Sequence: Synthetic peptide
  XENP018879 vhCDR3
YYGNYGGYFDV

SEQ ID NO: 9695 - protein, 11 aa, Artificial Sequence
  Description of Artificial Sequence: Synthetic peptide
  XENP018879 vlCDR1
RASQSVSNDVA

SEQ ID NO: 9696 - protein, 7 aa, Artificial Sequence
  Description of Artificial Sequence: Synthetic peptide
  XENP018879 vlCDR2
YASHRYT

SEQ ID NO: 9697 - protein, 9 aa, Artificial Sequence
  Description of Artificial Sequence: Synthetic peptide
  XENP018879 vlCDR3
QQDYDSPRT

SEQ ID NO: 9698 - protein, 249 aa, Artificial Sequence
  Description of Artificial Sequence: Synthetic polypeptide
  XENP018880 1G6_H1_L1.134_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYKSPRTFGGGTKVEIK

SEQ ID NO: 9699 - protein, 122 aa, Artificial Sequence; identical to SEQ ID NO: 6246
  Description of Artificial Sequence: Synthetic polypeptide
  VH of XENP018880

SEQ ID NO: 9700 - protein, 107 aa, Artificial Sequence
  Description of Artificial Sequence: Synthetic polypeptide
  VL of XENP018880
SIVMTQSPATLSVSPGERATLSCRASQSVSNDVAWYQQKPGQSPRLLINYASHRYTGVPDRFTGSGYGTEFTLTISSLQSEDFAVYFCQQDYKSPRTFGGGTKVEIK

SEQ ID NO: 9701 - protein, 5 aa, Artificial Sequence
  Description of Artificial Sequence: Synthetic peptide
  XENP018880 vhCDR1
NYWMN

SEQ ID NO: 9702 - protein, 19 aa, Artificial Sequence
  Description of Artificial Sequence: Synthetic peptide
  XENP018880 vhCDR2
EIRLKSNNYATHYAEPVKG

SEQ ID NO: 9703 - protein, 11 aa, Artificial Sequence
  Description of Artificial Sequence: Synthetic peptide
  XENP018880 vhCDR3
YYGNYGGYFDV

SEQ ID NO: 9704 - protein, 11 aa, Artificial Sequence
  Description of Artificial Sequence: Synthetic peptide
  XENP018880 vlCDR1
RASQSVSNDVA

SEQ ID NO: 9705 - protein, 7 aa, Artificial Sequence
  Description of Artificial Sequence: Synthetic peptide
  XENP018880 vlCDR2
YASHRYT

SEQ ID NO: 9706 - protein, 9 aa, Artificial Sequence
  Description of Artificial Sequence: Synthetic peptide
  XENP018880 vlCDR3
QQDYKSPRT

SEQ ID NO: 9707 - protein, 249 aa, Artificial Sequence
  Description of Artificial Sequence: Synthetic polypeptide
  XENP018881 1G6_H1_L1.135_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYFSPRTFGGGTKVEIK

SEQ ID NO: 9708 - protein, 122 aa, Artificial Sequence; identical to SEQ ID NO: 6246
  Description of Artificial Sequence: Synthetic polypeptide
  VH of XENP018881

SEQ ID NO: 9709 - protein, 107 aa, Artificial Sequence
  Description of Artificial Sequence: Synthetic polypeptide
  VL of XENP018881
SIVMTQSPATLSVSPGERATLSCRASQSVSNDVAWYQQKPGQSPRLLINYASHRYTGVPDRFTGSGYGTEFTLTISSLQSEDFAVYFCQQDYFSPRTFGGGTKVEIK

SEQ ID NO: 9710 - protein, 5 aa, Artificial Sequence
  Description of Artificial Sequence: Synthetic peptide
  XENP018881 vhCDR1
NYWMN

SEQ ID NO: 9711 - protein, 19 aa, Artificial Sequence
  Description of Artificial Sequence: Synthetic peptide
  XENP018881 vhCDR2
EIRLKSNNYATHYAEPVKG

SEQ ID NO: 9712 - protein, 11 aa, Artificial Sequence
  Description of Artificial Sequence: Synthetic peptide
  XENP018881 vhCDR3
YYGNYGGYFDV

SEQ ID NO: 9713 - protein, 11 aa, Artificial Sequence
  Description of Artificial Sequence: Synthetic peptide
  XENP018881 vlCDR1
RASQSVSNDVA

SEQ ID NO: 9714 - protein, 7 aa, Artificial Sequence
  Description of Artificial Sequence: Synthetic peptide
  XENP018881 vlCDR2
YASHRYT

SEQ ID NO: 9715 - protein, 9 aa, Artificial Sequence
  Description of Artificial Sequence: Synthetic peptide
  XENP018881 vlCDR3
QQDYFSPRT

SEQ ID NO: 9716 - protein, 249 aa, Artificial Sequence
  Description of Artificial Sequence: Synthetic polypeptide
  XENP018882 1G6_H1_L1.136_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSTPRTFGGGTKVEIK

SEQ ID NO: 9717 - protein, 122 aa, Artificial Sequence; identical to SEQ ID NO: 6246
  Description of Artificial Sequence: Synthetic polypeptide
  VH of XENP018882

SEQ ID NO: 9718 - protein, 107 aa, Artificial Sequence
  Description of Artificial Sequence: Synthetic polypeptide
  VL of XENP018882
SIVMTQSPATLSVSPGERATLSCRASQSVSNDVAWYQQKPGQSPRLLINYASHRYTGVPDRFTGSGYGTEFTLTISSLQSEDFAVYFCQQDYSTPRTFGGGTKVEIK

SEQ ID NO: 9719 - protein, 5 aa, Artificial Sequence
  Description of Artificial Sequence: Synthetic peptide
  XENP018882 vhCDR1
NYWMN

SEQ ID NO: 9720 - protein, 19 aa, Artificial Sequence
  Description of Artificial Sequence: Synthetic peptide
  XENP018882 vhCDR2
EIRLKSNNYATHYAEPVKG

SEQ ID NO: 9721 - protein, 11 aa, Artificial Sequence
  Description of Artificial Sequence: Synthetic peptide
  XENP018882 vhCDR3
YYGNYGGYFDV

SEQ ID NO: 9722 - protein, 11 aa, Artificial Sequence
  Description of Artificial Sequence: Synthetic peptide
  XENP018882 vlCDR1
RASQSVSNDVA

SEQ ID NO: 9723 - protein, 7 aa, Artificial Sequence
  Description of Artificial Sequence: Synthetic peptide
  XENP018882 vlCDR2
YASHRYT

SEQ ID NO: 9724 - protein, 9 aa, Artificial Sequence
  Description of Artificial Sequence: Synthetic peptide
  XENP018882 vlCDR3
QQDYSTPRT

SEQ ID NO: 9725 - protein, 249 aa, Artificial Sequence
  Description of Artificial Sequence: Synthetic polypeptide
  XENP018883 1G6_H1_L1.137_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSAPRTFGGGTKVEIK

SEQ ID NO: 9726 - protein, 122 aa, Artificial Sequence; identical to SEQ ID NO: 6246
  Description of Artificial Sequence: Synthetic polypeptide
  VH of XENP018883

SEQ ID NO: 9727 - protein, 107 aa, Artificial Sequence
  Description of Artificial Sequence: Synthetic polypeptide
  VL of XENP018883
SIVMTQSPATLSVSPGERATLSCRASQSVSNDVAWYQQKPGQSPRLLINYASHRYTGVPDRFTGSGYGTEFTLTISSLQSEDFAVYFCQQDYSAPRTFGGGTKVEIK

SEQ ID NO: 9728 - protein, 5 aa, Artificial Sequence
  Description of Artificial Sequence: Synthetic peptide
  XENP018883 vhCDR1
NYWMN

SEQ ID NO: 9729 - protein, 19 aa, Artificial Sequence
  Description of Artificial Sequence: Synthetic peptide
  XENP018883 vhCDR2
EIRLKSNNYATHYAEPVKG

SEQ ID NO: 9730 - protein, 11 aa, Artificial Sequence
  Description of Artificial Sequence: Synthetic peptide
  XENP018883 vhCDR3
YYGNYGGYFDV

SEQ ID NO: 9731 - protein, 11 aa, Artificial Sequence
  Description of Artificial Sequence: Synthetic peptide
  XENP018883 vlCDR1
RASQSVSNDVA

SEQ ID NO: 9732 - protein, 7 aa, Artificial Sequence
  Description of Artificial Sequence: Synthetic peptide
  XENP018883 vlCDR2
YASHRYT

SEQ ID NO: 9733 - protein, 9 aa, Artificial Sequence
  Description of Artificial Sequence: Synthetic peptide
  XENP018883 vlCDR3
QQDYSAPRT

SEQ ID NO: 9734 - protein, 249 aa, Artificial Sequence
  Description of Artificial Sequence: Synthetic polypeptide
  XENP018884 1G6_H1_L1.138_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSNPRTFGGGTKVEIK

SEQ ID NO: 9735 - protein, 122 aa, Artificial Sequence; identical to SEQ ID NO: 6246
  Description of Artificial Sequence: Synthetic polypeptide
  VH of XENP018884

SEQ ID NO: 9736 - protein, 107 aa, Artificial Sequence
  Description of Artificial Sequence: Synthetic polypeptide
  VL of XENP018884
SIVMTQSPATLSVSPGERATLSCRASQSVSNDVAWYQQKPGQSPRLLINYASHRYTGVPDRFTGSGYGTEFTLTISSLQSEDFAVYFCQQDYSNPRTFGGGTKVEIK

SEQ ID NO: 9737 - protein, 5 aa, Artificial Sequence
  Description of Artificial Sequence: Synthetic peptide
  XENP018884 vhCDR1
NYWMN

SEQ ID NO: 9738 - protein, 19 aa, Artificial Sequence
  Description of Artificial Sequence: Synthetic peptide
  XENP018884 vhCDR2
EIRLKSNNYATHYAEPVKG

SEQ ID NO: 9739 - protein, 11 aa, Artificial Sequence
  Description of Artificial Sequence: Synthetic peptide
  XENP018884 vhCDR3
YYGNYGGYFDV

SEQ ID NO: 9740 - protein, 11 aa, Artificial Sequence
  Description of Artificial Sequence: Synthetic peptide
  XENP018884 vlCDR1
RASQSVSNDVA

SEQ ID NO: 9741 - protein, 7 aa, Artificial Sequence
  Description of Artificial Sequence: Synthetic peptide
  XENP018884 vlCDR2
YASHRYT

SEQ ID NO: 9742 - protein, 9 aa, Artificial Sequence
  Description of Artificial Sequence: Synthetic peptide
  XENP018884 vlCDR3
QQDYSNPRT

SEQ ID NO: 9743 - protein, 249 aa, Artificial Sequence
  Description of Artificial Sequence: Synthetic polypeptide
  XENP018885 1G6_H1_L1.139_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSGPRTFGGGTKVEIK

SEQ ID NO: 9744 - protein, 122 aa, Artificial Sequence; identical to SEQ ID NO: 6246
  Description of Artificial Sequence: Synthetic polypeptide
  VH of XENP018885

SEQ ID NO: 9745 - protein, 107 aa, Artificial Sequence
  Description of Artificial Sequence: Synthetic polypeptide
  VL of XENP018885
SIVMTQSPATLSVSPGERATLSCRASQSVSNDVAWYQQKPGQSPRLLINYASHRYTGVPDRFTGSGYGTEFTLTISSLQSEDFAVYFCQQDYSGPRTFGGGTKVEIK

SEQ ID NO: 9746 - protein, 5 aa, Artificial Sequence
  Description of Artificial Sequence: Synthetic peptide
  XENP018885 vhCDR1
NYWMN

SEQ ID NO: 9747 - protein, 19 aa, Artificial Sequence
  Description of Artificial Sequence: Synthetic peptide
  XENP018885 vhCDR2
EIRLKSNNYATHYAEPVKG

SEQ ID NO: 9748 - protein, 11 aa, Artificial Sequence
  Description of Artificial Sequence: Synthetic peptide
  XENP018885 vhCDR3
YYGNYGGYFDV

SEQ ID NO: 9749 - protein, 11 aa, Artificial Sequence
  Description of Artificial Sequence: Synthetic peptide
  XENP018885 vlCDR1
RASQSVSNDVA

SEQ ID NO: 9750 - protein, 7 aa, Artificial Sequence
  Description of Artificial Sequence: Synthetic peptide
  XENP018885 vlCDR2
YASHRYT

SEQ ID NO: 9751 - protein, 9 aa, Artificial Sequence
  Description of Artificial Sequence: Synthetic peptide
  XENP018885 vlCDR3
QQDYSGPRT

SEQ ID NO: 9752 - protein, 249 aa, Artificial Sequence
  Description of Artificial Sequence: Synthetic polypeptide
  XENP018886 1G6_H1_L1.140_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSVPRTFGGGTKVEIK

SEQ ID NO: 9753 - protein, 122 aa, Artificial Sequence; identical to SEQ ID NO: 6246
  Description of Artificial Sequence: Synthetic polypeptide
  VH of XENP018886

SEQ ID NO: 9754 - protein, 107 aa, Artificial Sequence
  Description of Artificial Sequence: Synthetic polypeptide
  VL of XENP018886
SIVMTQSPATLSVSPGERATLSCRASQSVSNDVAWYQQKPGQSPRLLINYASHRYTGVPDRFTGSGYGTEFTLTISSLQSEDFAVYFCQQDYSVPRTFGGGTKVEIK

SEQ ID NO: 9755 - protein, 5 aa, Artificial Sequence
  Description of Artificial Sequence: Synthetic peptide
  XENP018886 vhCDR1
NYWMN

SEQ ID NO: 9756 - protein, 19 aa, Artificial Sequence
  Description of Artificial Sequence: Synthetic peptide
  XENP018886 vhCDR2
EIRLKSNNYATHYAEPVKG

SEQ ID NO: 9757 - protein, 11 aa, Artificial Sequence
  Description of Artificial Sequence: Synthetic peptide
  XENP018886 vhCDR3
YYGNYGGYFDV

SEQ ID NO: 9758 - protein, 11 aa, Artificial Sequence
  Description of Artificial Sequence: Synthetic peptide
  XENP018886 vlCDR1
RASQSVSNDVA

SEQ ID NO: 9759 - protein, 7 aa, Artificial Sequence
  Description of Artificial Sequence: Synthetic peptide
  XENP018886 vlCDR2
YASHRYT

SEQ ID NO: 9760 - protein, 9 aa, Artificial Sequence
  Description of Artificial Sequence: Synthetic peptide
  XENP018886 vlCDR3
QQDYSVPRT

SEQ ID NO: 9761 - protein, 249 aa, Artificial Sequence
  Description of Artificial Sequence: Synthetic polypeptide
  XENP018887 1G6_H1_L1.141_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSHPRTFGGGTKVEIK

SEQ ID NO: 9762 - protein, 122 aa, Artificial Sequence; identical to SEQ ID NO: 6246
  Description of Artificial Sequence: Synthetic polypeptide
  VH of XENP018887

SEQ ID NO: 9763 - protein, 107 aa, Artificial Sequence
  Description of Artificial Sequence: Synthetic polypeptide
  VL of XENP018887
SIVMTQSPATLSVSPGERATLSCRASQSVSNDVAWYQQKPGQSPRLLINYASHRYTGVPDRFTGSGYGTEFTLTISSLQSEDFAVYFCQQDYSHPRTFGGGTKVEIK

SEQ ID NO: 9764 - protein, 5 aa, Artificial Sequence
  Description of Artificial Sequence: Synthetic peptide
  XENP018887 vhCDR1
NYWMN

SEQ ID NO: 9765 - protein, 19 aa, Artificial Sequence
  Description of Artificial Sequence: Synthetic peptide
  XENP018887 vhCDR2
EIRLKSNNYATHYAEPVKG

SEQ ID NO: 9766 - protein, 11 aa, Artificial Sequence
  Description of Artificial Sequence: Synthetic peptide
  XENP018887 vhCDR3
YYGNYGGYFDV

SEQ ID NO: 9767 - protein, 11 aa, Artificial Sequence
  Description of Artificial Sequence: Synthetic peptide
  XENP018887 vlCDR1
RASQSVSNDVA

SEQ ID NO: 9768 - protein, 7 aa, Artificial Sequence
  Description of Artificial Sequence: Synthetic peptide
  XENP018887 vlCDR2
YASHRYT

SEQ ID NO: 9769 - protein, 9 aa, Artificial Sequence
  Description of Artificial Sequence: Synthetic peptide
  XENP018887 vlCDR3
QQDYSHPRT

SEQ ID NO: 9770 - protein, 249 aa, Artificial Sequence
  Description of Artificial Sequence: Synthetic polypeptide
  XENP018888 1G6_H1_L1.142_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSDPRTFGGGTKVEIK

SEQ ID NO: 9771 - protein, 122 aa, Artificial Sequence; identical to SEQ ID NO: 6246
  Description of Artificial Sequence: Synthetic polypeptide
  VH of XENP018888

SEQ ID NO: 9772 - protein, 107 aa, Artificial Sequence
  Description of Artificial Sequence: Synthetic polypeptide
  VL of XENP018888
SIVMTQSPATLSVSPGERATLSCRASQSVSNDVAWYQQKPGQSPRLLINYASHRYTGVPDRFTGSGYGTEFTLTISSLQSEDFAVYFCQQDYSDPRTFGGGTKVEIK

SEQ ID NO: 9773 - protein, 5 aa, Artificial Sequence
  Description of Artificial Sequence: Synthetic peptide
  XENP018888 vhCDR1
NYWMN

SEQ ID NO: 9774 - protein, 19 aa, Artificial Sequence
  Description of Artificial Sequence: Synthetic peptide
  XENP018888 vhCDR2
EIRLKSNNYATHYAEPVKG

SEQ ID NO: 9775 - protein, 11 aa, Artificial Sequence
  Description of Artificial Sequence: Synthetic peptide
  XENP018888 vhCDR3
YYGNYGGYFDV

SEQ ID NO: 9776 - protein, 11 aa, Artificial Sequence
  Description of Artificial Sequence: Synthetic peptide
  XENP018888 vlCDR1
RASQSVSNDVA

SEQ ID NO: 9777 - protein, 7 aa, Artificial Sequence
  Description of Artificial Sequence: Synthetic peptide
  XENP018888 vlCDR2
YASHRYT

SEQ ID NO: 9778 - protein, 9 aa, Artificial Sequence
  Description of Artificial Sequence: Synthetic peptide
  XENP018888 vlCDR3
QQDYSDPRT

SEQ ID NO: 9779 - protein, 249 aa, Artificial Sequence
  Description of Artificial Sequence: Synthetic polypeptide
  XENP018889 1G6_H1_L1.143_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSKPRTFGGGTKVEIK

SEQ ID NO: 9780 - protein, 122 aa, Artificial Sequence; identical to SEQ ID NO: 6246
  Description of Artificial Sequence: Synthetic polypeptide
  VH of XENP018889

SEQ ID NO: 9781 - protein, 107 aa, Artificial Sequence
  Description of Artificial Sequence: Synthetic polypeptide
  VL of XENP018889
SIVMTQSPATLSVSPGERATLSCRASQSVSNDVAWYQQKPGQSPRLLINYASHRYTGVPDRFTGSGYGTEFTLTISSLQSEDFAVYFCQQDYSKPRTFGGGTKVEIK

SEQ ID NO: 9782 - protein, 5 aa, Artificial Sequence
  Description of Artificial Sequence: Synthetic peptide
  XENP018889 vhCDR1
NYWMN

SEQ ID NO: 9783 - protein, 19 aa, Artificial Sequence
  Description of Artificial Sequence: Synthetic peptide
  XENP018889 vhCDR2
EIRLKSNNYATHYAEPVKG

SEQ ID NO: 9784 - protein, 11 aa, Artificial Sequence
  Description of Artificial Sequence: Synthetic peptide
  XENP018889 vhCDR3
YYGNYGGYFDV

SEQ ID NO: 9785 - protein, 11 aa, Artificial Sequence
  Description of Artificial Sequence: Synthetic peptide
  XENP018889 vlCDR1
RASQSVSNDVA

SEQ ID NO: 9786 - protein, 7 aa, Artificial Sequence
  Description of Artificial Sequence: Synthetic peptide
  XENP018889 vlCDR2
YASHRYT

SEQ ID NO: 9787 - protein, 9 aa, Artificial Sequence
  Description of Artificial Sequence: Synthetic peptide
  XENP018889 vlCDR3
QQDYSKPRT

SEQ ID NO: 9788 - protein, 249 aa, Artificial Sequence
  Description of Artificial Sequence: Synthetic polypeptide
  XENP018890 1G6_H1_L1.144_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSFPRTFGGGTKVEIK

SEQ ID NO: 9789 - protein, 122 aa, Artificial Sequence; identical to SEQ ID NO: 6246
  Description of Artificial Sequence: Synthetic polypeptide
  VH of XENP018890

SEQ ID NO: 9790 - protein, 107 aa, Artificial Sequence
  Description of Artificial Sequence: Synthetic polypeptide
  VL of XENP018890
SIVMTQSPATLSVSPGERATLSCRASQSVSNDVAWYQQKPGQSPRLLINYASHRYTGVPDRFTGSGYGTEFTLTISSLQSEDFAVYFCQQDYSFPRTFGGGTKVEIK

SEQ ID NO: 9791 - protein, 5 aa, Artificial Sequence
  Description of Artificial Sequence: Synthetic peptide
  XENP018890 vhCDR1
NYWMN

SEQ ID NO: 9792 - protein, 19 aa, Artificial Sequence
  Description of Artificial Sequence: Synthetic peptide
  XENP018890 vhCDR2
EIRLKSNNYATHYAEPVKG

SEQ ID NO: 9793 - protein, 11 aa, Artificial Sequence
  Description of Artificial Sequence: Synthetic peptide
  XENP018890 vhCDR3
YYGNYGGYFDV

SEQ ID NO: 9794 - protein, 11 aa, Artificial Sequence
  Description of Artificial Sequence: Synthetic peptide
  XENP018890 vlCDR1
RASQSVSNDVA

SEQ ID NO: 9795 - protein, 7 aa, Artificial Sequence
  Description of Artificial Sequence: Synthetic peptide
  XENP018890 vlCDR2
YASHRYT

SEQ ID NO: 9796 - protein, 9 aa, Artificial Sequence
  Description of Artificial Sequence: Synthetic peptide
  XENP018890 vlCDR3
QQDYSFPRT

SEQ ID NO: 9797 - protein, 249 aa, Artificial Sequence
  Description of Artificial Sequence: Synthetic polypeptide
  XENP018891 1G6_H1_L1.145_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKLEIK

SEQ ID NO: 9798 - protein, 122 aa, Artificial Sequence; identical to SEQ ID NO: 6246
  Description of Artificial Sequence: Synthetic polypeptide
  VH of XENP018891

SEQ ID NO: 9799 - protein, 107 aa, Artificial Sequence
  Description of Artificial Sequence: Synthetic polypeptide
  VL of XENP018891
SIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKLEIK

SEQ ID NO: 9800 - protein, 5 aa, Artificial Sequence
  Description of Artificial Sequence: Synthetic peptide
  XENP018891 vhCDR1
NYWMN

SEQ ID NO: 9801 - protein, 19 aa, Artificial Sequence
  Description of Artificial Sequence: Synthetic peptide
  XENP018891 vhCDR2
EIRLKSNNYATHYAEPVKG

SEQ ID NO: 9802 - protein, 11 aa, Artificial Sequence
  Description of Artificial Sequence: Synthetic peptide
  XENP018891 vhCDR3
YYGNYGGYFDV

SEQ ID NO: 9803 - protein, 11 aa, Artificial Sequence
  Description of Artificial Sequence: Synthetic peptide
  XENP018891 vlCDR1
RASQSVSNDVA

SEQ ID NO: 9804 - protein, 7 aa, Artificial Sequence
  Description of Artificial Sequence: Synthetic peptide
  XENP018891 vlCDR2
YASHRYT

SEQ ID NO: 9805 - protein, 9 aa, Artificial Sequence
  Description of Artificial Sequence: Synthetic peptide
  XENP018891 vlCDR3
QQDYSSPRT

SEQ ID NO: 9806 - protein, 249 aa, Artificial Sequence
  Description of Artificial Sequence: Synthetic polypeptide
  XENP018895 1G6_H0L0_scFv(GKPGS)4
EVKLEESGGGLVQPGGSMKLSCVASGFTFSNYWMNWVRQSPEKGLEWVAEIRLKSNNYATHYAESVKGRFTISRDDSKSSVYLQMNNLRAEDTGIYYCTRYYGNYGGYFDVWGAGTTVTVSSGKPGSGKPGSGKPGSGKPGSSIVMTQTPKFLLVSAGDRVTITCKASQSVSNDVAWYQQKPGQSPKLLINYASHRYTGVPDRFTGSGYGTDFTFTISTVQAEDLAVYFCQQDYSSPRTFGGGTKLEIK

SEQ ID NO: 9807 - protein, 122 aa, Artificial Sequence
  Description of Artificial Sequence: Synthetic polypeptide
  VH of XENP018895
EVKLEESGGGLVQPGGSMKLSCVASGFTFSNYWMNWVRQSPEKGLEWVAEIRLKSNNYATHYAESVKGRFTISRDDSKSSVYLQMNNLRAEDTGIYYCTRYYGNYGGYFDVWGAGTTVTVSS

SEQ ID NO: 9808 - protein, 107 aa, Artificial Sequence
  Description of Artificial Sequence: Synthetic polypeptide
  VL of XENP018895
SIVMTQTPKFLLVSAGDRVTITCKASQSVSNDVAWYQQKPGQSPKLLINYASHRYTGVPDRFTGSGYGTDFTFTISTVQAEDLAVYFCQQDYSSPRTFGGGTKLEIK

SEQ ID NO: 9809 - protein, 5 aa, Artificial Sequence
  Description of Artificial Sequence: Synthetic peptide
  XENP018895 vhCDR1
NYWMN

SEQ ID NO: 9810 - protein, 19 aa, Artificial Sequence
  Description of Artificial Sequence: Synthetic peptide
  XENP018895 vhCDR2
EIRLKSNNYATHYAESVKG

SEQ ID NO: 9811 - protein, 11 aa, Artificial Sequence
  Description of Artificial Sequence: Synthetic peptide
  XENP018895 vhCDR3
YYGNYGGYFDV

SEQ ID NO: 9812 - protein, 11 aa, Artificial Sequence
  Description of Artificial Sequence: Synthetic peptide
  XENP018895 vlCDR1
KASQSVSNDVA

SEQ ID NO: 9813 - protein, 7 aa, Artificial Sequence
  Description of Artificial Sequence: Synthetic peptide
  XENP018895 vlCDR2
YASHRYT

SEQ ID NO: 9814 - protein, 9 aa, Artificial Sequence
  Description of Artificial Sequence: Synthetic peptide
  XENP018895 vlCDR3
QQDYSSPRT

SEQ ID NO: 9815 - protein, 249 aa, Artificial Sequence
  Description of Artificial Sequence: Synthetic polypeptide
  XENP018896 1G6_L1H1_scFv(GKPGS)4
SIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIKGKPGSGKPGSGKPGSGKPGSEVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 9816 - protein, 107 aa, Artificial Sequence; identical to SEQ ID NO: 6247
  Description of Artificial Sequence: Synthetic polypeptide
  VH of XENP018896

SEQ ID NO: 9817 - protein, 122 aa, Artificial Sequence; identical to SEQ ID NO: 6246
  Description of Artificial Sequence: Synthetic polypeptide
  VL of XENP018896

SEQ ID NO: 9818 - protein, 11 aa, Artificial Sequence
  Description of Artificial Sequence: Synthetic peptide
  XENP018896 vhCDR1
RASQSVSNDVA

SEQ ID NO: 9819 - protein, 7 aa, Artificial Sequence
  Description of Artificial Sequence: Synthetic peptide
  XENP018896 vhCDR2
YASHRYT

SEQ ID NO: 9820 - protein, 9 aa, Artificial Sequence
  Description of Artificial Sequence: Synthetic peptide
  XENP018896 vhCDR3
QQDYSSPRT

SEQ ID NO: 9821 - protein, 5 aa, Artificial Sequence
  Description of Artificial Sequence: Synthetic peptide
  XENP018896 vlCDR1
NYWMN

SEQ ID NO: 9822 - protein, 19 aa, Artificial Sequence
  Description of Artificial Sequence: Synthetic peptide
  XENP018896 vlCDR2
EIRLKSNNYATHYAEPVKG

SEQ ID NO: 9823 - protein, 11 aa, Artificial Sequence
  Description of Artificial Sequence: Synthetic peptide
  XENP018896 vlCDR3
YYGNYGGYFDV

SEQ ID NO: 9824 - protein, 244 aa, Artificial Sequence
  Description of Artificial Sequence: Synthetic polypeptide
  XENP018901 6A3_H0L0_scFv(GKPGS)4
EVKLVESGGGLVKPGGSLKLSCAASGFTFSSYGMSWVRQTPEKRLEWVATISGGGRYTYYPDSVKGRFTISRDNAKNNLYLQMSSLRSEDTALYYCASYYDSSFDYWGQGTTLTVSSGKPGSGKPGSGKPGSGKPGSDIVMTQSHKFMSTSVGDRVSITCKASQDVGTAVAWYQQKPGQSPKLLIYWASTRHTGVPDRFTGSGSGTDFTLTISNVQSEDLADYFCQHYSIYPWTFGGGTKLEIK

SEQ ID NO: 9825 - protein, 117 aa, Artificial Sequence
  Description of Artificial Sequence: Synthetic polypeptide
  VH of XENP018901
EVKLVESGGGLVKPGGSLKLSCAASGFTFSSYGMSWVRQTPEKRLEWVATISGGGRYTYYPDSVKGRFTISRDNAKNNLYLQMSSLRSEDTALYYCASYYDSSFDYWGQGTTLTVSS

SEQ ID NO: 9826 - protein, 107 aa, Artificial Sequence
  Description of Artificial Sequence: Synthetic polypeptide
  VL of XENP018901
DIVMTQSHKFMSTSVGDRVSITCKASQDVGTAVAWYQQKPGQSPKLLIYWASTRHTGVPDRFTGSGSGTDFTLTISNVQSEDLADYFCQHYSIYPWTFGGGTKLEIK

SEQ ID NO: 9827 - protein, 5 aa, Artificial Sequence
  Description of Artificial Sequence: Synthetic peptide
  XENP018901 vhCDR1
SYGMS

SEQ ID NO: 9828 - protein, 17 aa, Artificial Sequence
  Description of Artificial Sequence: Synthetic peptide
  XENP018901 vhCDR2
TISGGGRYTYYPDSVKG

SEQ ID NO: 9829 - protein, 8 aa, Artificial Sequence
  Description of Artificial Sequence: Synthetic peptide
  XENP018901 vhCDR3
YYDSSFDY

SEQ ID NO: 9830 - protein, 11 aa, Artificial Sequence
  Description of Artificial Sequence: Synthetic peptide
  XENP018901 vlCDR1
KASQDVGTAVA

SEQ ID NO: 9831 - protein, 7 aa, Artificial Sequence
  Description of Artificial Sequence: Synthetic peptide
  XENP018901 vlCDR2
WASTRHT

SEQ ID NO: 9832 - protein, 9 aa, Artificial Sequence
  Description of Artificial Sequence: Synthetic peptide
  XENP018901 vlCDR3
QHYSIYPWT

SEQ ID NO: 9833 - protein, 244 aa, Artificial Sequence
  Description of Artificial Sequence: Synthetic polypeptide
  XENP018902 6A3_L3_H1.1_scFv(GKPGS)4
DIVMTQSPSSLSASVGDRVTITCRASQDVGTAVAWYQQKPGKSPKLLIYWASTRHTGVPDRFTGSGSGTDFTLTISSLQPEDFATYFCQHYSIYPWTFGGGTKVEIKGKPGSGKPGSGKPGSGKPGSEVQLLESGGGLVQPGGSLRLSCAASGFTFSSYGMSWVRQAPGKGLEWVSTISGGGRYTYYPDSVKGRFTISRDNSKNTLYLQMNSLRAEDTAVYYCASYYDSSFDYWGQGTLVTVSS

SEQ ID NO: 9834 - protein, 107 aa, Artificial Sequence; identical to SEQ ID NO: 6337
  Description of Artificial Sequence: Synthetic polypeptide
  VH of XENP018902

SEQ ID NO: 9835 - protein, 117 aa, Artificial Sequence; identical to SEQ ID NO: 6354
  Description of Artificial Sequence: Synthetic polypeptide
  VL of XENP018902

SEQ ID NO: 9836 - protein, 11 aa, Artificial Sequence
  Description of Artificial Sequence: Synthetic peptide
  XENP018902 vhCDR1
RASQDVGTAVA

SEQ ID NO: 9837 - protein, 7 aa, Artificial Sequence
  Description of Artificial Sequence: Synthetic peptide
  XENP018902 vhCDR2
WASTRHT

SEQ ID NO: 9838 - protein, 9 aa, Artificial Sequence
  Description of Artificial Sequence: Synthetic peptide
  XENP018902 vhCDR3
QHYSIYPWT

SEQ ID NO: 9839 - protein, 5 aa, Artificial Sequence
  Description of Artificial Sequence: Synthetic peptide
  XENP018902 vlCDR1
SYGMS

SEQ ID NO: 9840 - protein, 17 aa, Artificial Sequence
  Description of Artificial Sequence: Synthetic peptide
  XENP018902 vlCDR2
TISGGGRYTYYPDSVKG

SEQ ID NO: 9841 - protein, 9 aa, Artificial Sequence
  Description of Artificial Sequence: Synthetic peptide
  XENP018902 vlCDR3
SYYDSSFDY

SEQ ID NO: 9842 - protein, 249 aa, Artificial Sequence
  Description of Artificial Sequence: Synthetic polypeptide
  XENP018921 1G6_H1L3_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPLSLPVTPGEPASISCRASQSVSNDVAWYLQKPGQSPQLLINYASHRYTGVPDRFTGSGYGTDFTLKISRVEAEDVGVYFCQQDYSSPRTFGGGTKVEIK

SEQ ID NO: 9843 - protein, 122 aa, Artificial Sequence; identical to SEQ ID NO: 6246
  Description of Artificial Sequence: Synthetic polypeptide
  VH of XENP018921

SEQ ID NO: 9844 - protein, 107 aa, Artificial Sequence
  Description of Artificial Sequence: Synthetic polypeptide
  VL of XENP018921
SIVMTQSPLSLPVTPGEPASISCRASQSVSNDVAWYLQKPGQSPQLLINYASHRYTGVPDRFTGSGYGTDFTLKISRVEAEDVGVYFCQQDYSSPRTFGGGTKVEIK

SEQ ID NO: 9845 - protein, 5 aa, Artificial Sequence
  Description of Artificial Sequence: Synthetic peptide
  XENP018921 vhCDR1
NYWMN

SEQ ID NO: 9846 - protein, 19 aa, Artificial Sequence
  Description of Artificial Sequence: Synthetic peptide
  XENP018921 vhCDR2
EIRLKSNNYATHYAEPVKG

SEQ ID NO: 9847 - protein, 11 aa, Artificial Sequence
  Description of Artificial Sequence: Synthetic peptide
  XENP018921 vhCDR3
YYGNYGGYFDV

SEQ ID NO: 9848 - protein, 11 aa, Artificial Sequence
  Description of Artificial Sequence: Synthetic peptide
  XENP018921 vlCDR1
RASQSVSNDVA

SEQ ID NO: 9849 - protein, 7 aa, Artificial Sequence
  Description of Artificial Sequence: Synthetic peptide
  XENP018921 vlCDR2
YASHRYT

SEQ ID NO: 9850 - protein, 9 aa, Artificial Sequence
  Description of Artificial Sequence: Synthetic peptide
  XENP018921 vlCDR3
QQDYSSPRT

SEQ ID NO: 9851 - protein, 249 aa, Artificial Sequence
  Description of Artificial Sequence: Synthetic polypeptide
  XENP018922 1G6_H1L4_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPGTLSLSPGERATLSCRASQSVSNDVAWYQQKPGQSPRLLINYASHRYTGVPDRFTGSGYGTDFTLTISRLEPEDFAVYFCQQDYSSPRTFGGGTKVEIK

SEQ ID NO: 9852 - protein, 122 aa, Artificial Sequence; identical to SEQ ID NO: 6246
  Description of Artificial Sequence: Synthetic polypeptide
  VH of XENP018922

SEQ ID NO: 9853 - protein, 107 aa, Artificial Sequence
  Description of Artificial Sequence: Synthetic polypeptide
  VL of XENP018922
SIVMTQSPGTLSLSPGERATLSCRASQSVSNDVAWYQQKPGQSPRLLINYASHRYTGVPDRFTGSGYGTDFTLTISRLEPEDFAVYFCQQDYSSPRTFGGGTKVEIK

SEQ ID NO: 9854 - protein, 5 aa, Artificial Sequence
  Description of Artificial Sequence: Synthetic peptide
  XENP018922 vhCDR1
NYWMN

SEQ ID NO: 9855 - protein, 19 aa, Artificial Sequence
  Description of Artificial Sequence: Synthetic peptide
  XENP018922 vhCDR2
EIRLKSNNYATHYAEPVKG

SEQ ID NO: 9856 - protein, 11 aa, Artificial Sequence
  Description of Artificial Sequence: Synthetic peptide
  XENP018922 vhCDR3
YYGNYGGYFDV

SEQ ID NO: 9857 - protein, 11 aa, Artificial Sequence
  Description of Artificial Sequence: Synthetic peptide
  XENP018922 vlCDR1
RASQSVSNDVA

SEQ ID NO: 9858 - protein, 7 aa, Artificial Sequence
  Description of Artificial Sequence: Synthetic peptide
  XENP018922 vlCDR2
YASHRYT

SEQ ID NO: 9859 - protein, 9 aa, Artificial Sequence
  Description of Artificial Sequence: Synthetic peptide
  XENP018922 vlCDR3
QQDYSSPRT

SEQ ID NO: 9860 - protein, 249 aa, Artificial Sequence
  Description of Artificial Sequence: Synthetic polypeptide
  XENP018923 1G6_H1L5_scFv(GKPGS)4
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSSGKPGSGKPGSGKPGSGKPGSSIVMTQSPDSLAVSLGERATINCKASQSVSNDVAWYQQKPGQSPKLLINYASHRYTGVPDRFTGSGYGTDFTLTISSLQAEDVAVYFCQQDYSSPRTFGGGTKVEIK

SEQ ID NO: 9861 - protein, 122 aa, Artificial Sequence; identical to SEQ ID NO: 6246
  Description of Artificial Sequence: Synthetic polypeptide
  VH of XENP018923

SEQ ID NO: 9862 - protein, 107 aa, Artificial Sequence
  Description of Artificial Sequence: Synthetic polypeptide
  VL of XENP018923
SIVMTQSPDSLAVSLGERATINCKASQSVSNDVAWYQQKPGQSPKLLINYASHRYTGVPDRFTGSGYGTDFTLTISSLQAEDVAVYFCQQDYSSPRTFGGGTKVEIK

SEQ ID NO: 9863 - protein, 5 aa, Artificial Sequence
  Description of Artificial Sequence: Synthetic peptide
  XENP018923 vhCDR1
NYWMN

SEQ ID NO: 9864 - protein, 19 aa, Artificial Sequence
  Description of Artificial Sequence: Synthetic peptide
  XENP018923 vhCDR2
EIRLKSNNYATHYAEPVKG

SEQ ID NO: 9865 - protein, 11 aa, Artificial Sequence
  Description of Artificial Sequence: Synthetic peptide
  XENP018923 vhCDR3
YYGNYGGYFDV

SEQ ID NO: 9866 - protein, 11 aa, Artificial Sequence
  Description of Artificial Sequence: Synthetic peptide
  XENP018923 vlCDR1
KASQSVSNDVA

SEQ ID NO: 9867 - protein, 7 aa, Artificial Sequence
  Description of Artificial Sequence: Synthetic peptide
  XENP018923 vlCDR2
YASHRYT

SEQ ID NO: 9868 - protein, 9 aa, Artificial Sequence
  Description of Artificial Sequence: Synthetic peptide
  XENP018923 vlCDR3
QQDYSSPRT

SEQ ID NO: 9869 - protein, 249 aa, Artificial Sequence
  Description of Artificial Sequence: Synthetic polypeptide
  XENP018924 1G6_H2L1_scFv(GKPGS)4
QVQLVQSGAEVKKPGASVKVSCKASGFTFSNYWMNWVRQAPGQGLEWMGEIRLKSNNYATHYAEKFQGRVTMTRDDSTSTVYMELSSLRSEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 9870 - protein, 122 aa, Artificial Sequence
  Description of Artificial Sequence: Synthetic polypeptide
  VH of XENP018924
QVQLVQSGAEVKKPGASVKVSCKASGFTFSNYWMNWVRQAPGQGLEWMGEIRLKSNNYATHYAEKFQGRVTMTRDDSTSTVYMELSSLRSEDTAVYYCTRYYGNYGGYFDVWGAGTLVTVSS

SEQ ID NO: 9871 - protein, 107 aa, Artificial Sequence; identical to SEQ ID NO: 6247
  Description of Artificial Sequence: Synthetic polypeptide
  VL of XENP018924

SEQ ID NO: 9872 - protein, 5 aa, Artificial Sequence
  Description of Artificial Sequence: Synthetic peptide
  XENP018924 vhCDR1
NYWMN

SEQ ID NO: 9873 - protein, 19 aa, Artificial Sequence
  Description of Artificial Sequence: Synthetic peptide
  XENP018924 vhCDR2
EIRLKSNNYATHYAEKFQG

SEQ ID NO: 9874 - protein, 11 aa, Artificial Sequence
  Description of Artificial Sequence: Synthetic peptide
  XENP018924 vhCDR3
YYGNYGGYFDV

SEQ ID NO: 9875 - protein, 11 aa, Artificial Sequence
  Description of Artificial Sequence: Synthetic peptide
  XENP018924 vlCDR1
RASQSVSNDVA

SEQ ID NO: 9876 - protein, 7 aa, Artificial Sequence
  Description of Artificial Sequence: Synthetic peptide
  XENP018924 vlCDR2
YASHRYT

SEQ ID NO: 9877 - protein, 9 aa, Artificial Sequence
  Description of Artificial Sequence: Synthetic peptide
  XENP018924 vlCDR3
QQDYSSPRT

SEQ ID NO: 9878 - protein, 249 aa, Artificial Sequence
  Description of Artificial Sequence: Synthetic polypeptide
  XENP018925 1G6_H2L2_scFv(GKPGS)4
QVQLVQSGAEVKKPGASVKVSCKASGFTFSNYWMNWVRQAPGQGLEWMGEIRLKSNNYATHYAEKFQGRVTMTRDDSTSTVYMELSSLRSEDTAVYYCTRYYGNYGGYFDVWGAGTLVTVSSGKPGSGKPGSGKPGSGKPGSSIVMTQSPSSLSASVGDRVTITCRASQSVSNDVAWYQQKPGKSPKLLINYASHRYTGVPDRFTGSGYGTDFTLTISSLQPEDFATYFCQQDYSSPRTFGGGTKVEIK

SEQ ID NO: 9879 - protein, 122 aa, Artificial Sequence; identical to SEQ ID NO: 9870
  Description of Artificial Sequence: Synthetic polypeptide
  VH of XENP018925

SEQ ID NO: 9880 - protein, 107 aa, Artificial Sequence; identical to SEQ ID NO: 6256
  Description of Artificial Sequence: Synthetic polypeptide
  VL of XENP018925

SEQ ID NO: 9881 - protein, 5 aa, Artificial Sequence
  Description of Artificial Sequence: Synthetic peptide
  XENP018925 vhCDR1
NYWMN

SEQ ID NO: 9882 - protein, 19 aa, Artificial Sequence
  Description of Artificial Sequence: Synthetic peptide
  XENP018925 vhCDR2
EIRLKSNNYATHYAEKFQG

SEQ ID NO: 9883 - protein, 11 aa, Artificial Sequence
  Description of Artificial Sequence: Synthetic peptide
  XENP018925 vhCDR3
YYGNYGGYFDV

SEQ ID NO: 9884 - protein, 11 aa, Artificial Sequence
  Description of Artificial Sequence: Synthetic peptide
  XENP018925 vlCDR1
RASQSVSNDVA

SEQ ID NO: 9885 - protein, 7 aa, Artificial Sequence
  Description of Artificial Sequence: Synthetic peptide
  XENP018925 vlCDR2
YASHRYT

SEQ ID NO: 9886 - protein, 9 aa, Artificial Sequence
  Description of Artificial Sequence: Synthetic peptide
  XENP018925 vlCDR3
QQDYSSPRT

SEQ ID NO: 9887 - protein, 249 aa, Artificial Sequence
  Description of Artificial Sequence: Synthetic polypeptide
  XENP018926 1G6_H2L3_scFv(GKPGS)4
QVQLVQSGAEVKKPGASVKVSCKASGFTFSNYWMNWVRQAPGQGLEWMGEIRLKSNNYATHYAEKFQGRVTMTRDDSTSTVYMELSSLRSEDTAVYYCTRYYGNYGGYFDVWGAGTLVTVSSGKPGSGKPGSGKPGSGKPGSSIVMTQSPLSLPVTPGEPASISCRASQSVSNDVAWYLQKPGQSPQLLINYASHRYTGVPDRFTGSGYGTDFTLKISRVEAEDVGVYFCQQDYSSPRTFGGGTKVEIK

SEQ ID NO: 9888 - protein, 122 aa, Artificial Sequence; identical to SEQ ID NO: 9870
  Description of Artificial Sequence: Synthetic polypeptide
  VH of XENP018926

SEQ ID NO: 9889 - protein, 107 aa, Artificial Sequence; identical to SEQ ID NO: 9844
  Description of Artificial Sequence: Synthetic polypeptide
  VL of XENP018926

SEQ ID NO: 9890 - protein, 5 aa, Artificial Sequence
  Description of Artificial Sequence: Synthetic peptide
  XENP018926 vhCDR1
NYWMN

SEQ ID NO: 9891 - protein, 19 aa, Artificial Sequence
  Description of Artificial Sequence: Synthetic peptide
  XENP018926 vhCDR2
EIRLKSNNYATHYAEKFQG

SEQ ID NO: 9892 - protein, 11 aa, Artificial Sequence
  Description of Artificial Sequence: Synthetic peptide
  XENP018926 vhCDR3
YYGNYGGYFDV

SEQ ID NO: 9893 - protein, 11 aa, Artificial Sequence
  Description of Artificial Sequence: Synthetic peptide
  XENP018926 vlCDR1
RASQSVSNDVA

SEQ ID NO: 9894 - protein, 7 aa, Artificial Sequence
  Description of Artificial Sequence: Synthetic peptide
  XENP018926 vlCDR2
YASHRYT

SEQ ID NO: 9895 - protein, 9 aa, Artificial Sequence
  Description of Artificial Sequence: Synthetic peptide
  XENP018926 vlCDR3
QQDYSSPRT

SEQ ID NO: 9896 - protein, 249 aa, Artificial Sequence
  Description of Artificial Sequence: Synthetic polypeptide
  XENP018927 1G6_H2L4_scFv(GKPGS)4
QVQLVQSGAEVKKPGASVKVSCKASGFTFSNYWMNWVRQAPGQGLEWMGEIRLKSNNYATHYAEKFQGRVTMTRDDSTSTVYMELSSLRSEDTAVYYCTRYYGNYGGYFDVWGAGTLVTVSSGKPGSGKPGSGKPGSGKPGSSIVMTQSPGTLSLSPGERATLSCRASQSVSNDVAWYQQKPGQSPRLLINYASHRYTGVPDRFTGSGYGTDFTLTISRLEPEDFAVYFCQQDYSSPRTFGGGTKVEIK

SEQ ID NO: 9897 - protein, 122 aa, Artificial Sequence; identical to SEQ ID NO: 9870
  Description of Artificial Sequence: Synthetic polypeptide
  VH of XENP018927

SEQ ID NO: 9898 - protein, 107 aa, Artificial Sequence; identical to SEQ ID NO: 9853
  Description of Artificial Sequence: Synthetic polypeptide
  VL of XENP018927

SEQ ID NO: 9899 - protein, 5 aa, Artificial Sequence
  Description of Artificial Sequence: Synthetic peptide
  XENP018927 vhCDR1
NYWMN

SEQ ID NO: 9900 - protein, 19 aa, Artificial Sequence
  Description of Artificial Sequence: Synthetic peptide
  XENP018927 vhCDR2
EIRLKSNNYATHYAEKFQG

SEQ ID NO: 9901 - protein, 11 aa, Artificial Sequence
  Description of Artificial Sequence: Synthetic peptide
  XENP018927 vhCDR3
YYGNYGGYFDV

SEQ ID NO: 9902 - protein, 11 aa, Artificial Sequence
  Description of Artificial Sequence: Synthetic peptide
  XENP018927 vlCDR1
RASQSVSNDVA

SEQ ID NO: 9903 - protein, 7 aa, Artificial Sequence
  Description of Artificial Sequence: Synthetic peptide
  XENP018927 vlCDR2
YASHRYT

SEQ ID NO: 9904 - protein, 9 aa, Artificial Sequence
  Description of Artificial Sequence: Synthetic peptide
  XENP018927 vlCDR3
QQDYSSPRT

SEQ ID NO: 9905 - protein, 249 aa, Artificial Sequence
  Description of Artificial Sequence: Synthetic polypeptide
  XENP018928 1G6_H2L5_scFv(GKPGS)4
QVQLVQSGAEVKKPGASVKVSCKASGFTFSNYWMNWVRQAPGQGLEWMGEIRLKSNNYATHYAEKFQGRVTMTRDDSTSTVYMELSSLRSEDTAVYYCTRYYGNYGGYFDVWGAGTLVTVSSGKPGSGKPGSGKPGSGKPGSSIVMTQSPDSLAVSLGERATINCKASQSVSNDVAWYQQKPGQSPKLLINYASHRYTGVPDRFTGSGYGTDFTLTISSLQAEDVAVYFCQQDYSSPRTFGGGTKVEIK

SEQ ID NO: 9906 - protein, 122 aa, Artificial Sequence; identical to SEQ ID NO: 9870
  Description of Artificial Sequence: Synthetic polypeptide
  VH of XENP018928

SEQ ID NO: 9907 - protein, 107 aa, Artificial Sequence; identical to SEQ ID NO: 9862
  Description of Artificial Sequence: Synthetic polypeptide
  VL of XENP018928

SEQ ID NO: 9908 - protein, 5 aa, Artificial Sequence
  Description of Artificial Sequence: Synthetic peptide
  XENP018928 vhCDR1
NYWMN

SEQ ID NO: 9909 - protein, 19 aa, Artificial Sequence
  Description of Artificial Sequence: Synthetic peptide
  XENP018928 vhCDR2
EIRLKSNNYATHYAEKFQG

SEQ ID NO: 9910 - protein, 11 aa, Artificial Sequence
  Description of Artificial Sequence: Synthetic peptide
  XENP018928 vhCDR3
YYGNYGGYFDV

SEQ ID NO: 9911 - protein, 11 aa, Artificial Sequence
  Description of Artificial Sequence: Synthetic peptide
  XENP018928 vlCDR1
KASQSVSNDVA

SEQ ID NO: 9912 - protein, 7 aa, Artificial Sequence
  Description of Artificial Sequence: Synthetic peptide
  XENP018928 vlCDR2
YASHRYT

SEQ ID NO: 9913 - protein, 9 aa, Artificial Sequence
  Description of Artificial Sequence: Synthetic peptide
  XENP018928 vlCDR3
QQDYSSPRT

SEQ ID NO: 9914 - protein, 249 aa, Artificial Sequence
  Description of Artificial Sequence: Synthetic polypeptide
  XENP018929 1G6_H3L1_scFv(GKPGS)4
EVQLLESGGGLVQPGGSLRLSCAASGFTFSNYWMNWVRQAPGKGLEWVSEIRLKSNNYATHYAESVKGRFTISRDDSKSTVYLQMNSLRAEDTAVYYCTRYYGNYGGYFDVWGAGTLVTVSSGKPGSGKPGSGKPGSGKPGSSIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 9915 - protein, 122 aa, Artificial Sequence
  Description of Artificial Sequence: Synthetic polypeptide
  VH of XENP018929
EVQLLESGGGLVQPGGSLRLSCAASGFTFSNYWMNWVRQAPGKGLEWVSEIRLKSNNYATHYAESVKGRFTISRDDSKSTVYLQMNSLRAEDTAVYYCTRYYGNYGGYFDVWGAGTLVTVSS

SEQ ID NO: 9916 - protein, 107 aa, Artificial Sequence; identical to SEQ ID NO: 6247
  Description of Artificial Sequence: Synthetic polypeptide
  VL of XENP018929

SEQ ID NO: 9917 - protein, 5 aa, Artificial Sequence
  Description of Artificial Sequence: Synthetic peptide
  XENP018929 vhCDR1
NYWMN

SEQ ID NO: 9918 - protein, 19 aa, Artificial Sequence
  Description of Artificial Sequence: Synthetic peptide
  XENP018929 vhCDR2
EIRLKSNNYATHYAESVKG

SEQ ID NO: 9919 - protein, 11 aa, Artificial Sequence
  Description of Artificial Sequence: Synthetic peptide
  XENP018929 vhCDR3
YYGNYGGYFDV

SEQ ID NO: 9920 - protein, 11 aa, Artificial Sequence
  Description of Artificial Sequence: Synthetic peptide
  XENP018929 vlCDR1
RASQSVSNDVA

SEQ ID NO: 9921 - protein, 7 aa, Artificial Sequence
  Description of Artificial Sequence: Synthetic peptide
  XENP018929 vlCDR2
YASHRYT

SEQ ID NO: 9922 - protein, 9 aa, Artificial Sequence
  Description of Artificial Sequence: Synthetic peptide
  XENP018929 vlCDR3
QQDYSSPRT

SEQ ID NO: 9923 - protein, 249 aa, Artificial Sequence
  Description of Artificial Sequence: Synthetic polypeptide
  XENP018930 1G6_H3L2_scFv(GKPGS)4
EVQLLESGGGLVQPGGSLRLSCAASGFTFSNYWMNWVRQAPGKGLEWVSEIRLKSNNYATHYAESVKGRFTISRDDSKSTVYLQMNSLRAEDTAVYYCTRYYGNYGGYFDVWGAGTLVTVSSGKPGSGKPGSGKPGSGKPGSSIVMTQSPSSLSASVGDRVTITCRASQSVSNDVAWYQQKPGKSPKLLINYASHRYTGVPDRFTGSGYGTDFTLTISSLQPEDFATYFCQQDYSSPRTFGGGTKVEIK

SEQ ID NO: 9924 - protein, 122 aa, Artificial Sequence; identical to SEQ ID NO: 9915
  Description of Artificial Sequence: Synthetic polypeptide
  VH of XENP018930

SEQ ID NO: 9925 - protein, 107 aa, Artificial Sequence; identical to SEQ ID NO: 6256
  Description of Artificial Sequence: Synthetic polypeptide
  VL of XENP018930

SEQ ID NO: 9926 - protein, 5 aa, Artificial Sequence
  Description of Artificial Sequence: Synthetic peptide
  XENP018930 vhCDR1
NYWMN

SEQ ID NO: 9927 - protein, 19 aa, Artificial Sequence
  Description of Artificial Sequence: Synthetic peptide
  XENP018930 vhCDR2
EIRLKSNNYATHYAESVKG

(The sequence listing continues in the following parts.)

What is claimed is:

1. A method for treating cancer comprising administering to a patient in need thereof:
   a) a heterodimeric bispecific antibody that binds CTLA-4 and LAG-3; and
   b) an anti-PD-1 antibody,
   wherein said heterodimeric bispecific antibody comprises:
   i) a first monomer comprising
      A) a single chain Fv domain (scFv) that binds human CTLA-4, wherein said scFv domain comprises:
      1) a first variable heavy domain (VH1);
      2) a scFv linker; and
      3) a first variable light domain (VL1); and
      B) a first variant Fc domain;
   ii) a second monomer comprising a VH2-CH1-hinge-CH2-CH3 heavy chain, wherein VH2 is a second variable heavy domain and CH2-CH3 is a second variant Fc domain; and
   c) a light chain comprising a second variable light domain (VL2) and a constant light domain (CL);
   wherein said VH2 and said VL2 bind LAG-3, wherein said VH1 comprises a vhCDR1 comprising the amino acid sequence of SEQ ID NO:35616, a vhCDR2 comprising the amino acid sequence SEQ ID NO:35617 and a vhCDR3 comprising the amino acid sequence of SEQ ID NO:35618, said VL1 comprises a vlCDR1 comprising the amino acid sequence of SEQ ID NO:35619, a vlCDR2 comprising the amino acid sequence SEQ ID NO:35620 and a vlCDR3 comprising the amino acid sequence of SEQ ID NO:35621, and wherein said VH2 comprises a vhCDR1 comprising the amino acid sequence of SEQ ID NO:35609, a vhCDR2 comprising the amino acid sequence SEQ ID NO:35610 and a vhCDR3 comprising the amino acid sequence of SEQ ID NO:35611, said VL2 comprises a vlCDR1 comprising the amino acid sequence of SEQ ID NO:35624, a vlCDR2 comprising the amino acid sequence SEQ ID NO:35625 and a vlCDR3 comprising the amino acid sequence of SEQ ID NO:35626.

2. A method according to claim 1, wherein said VH1 comprises SEQ ID NO:35613, VL1 comprises SEQ ID NO:35614, VH2 comprises SEQ ID NO:35608 and VL2 has SEQ ID NO:35623.

3. A method for treating cancer comprising administering to a patient in need thereof:
   a) a heterodimeric bispecific antibody that binds CTLA-4 and LAG-3; and
   b) an anti-PD-1 antibody,
wherein said heterodimeric bispecific antibody comprises:
   i) a first monomer comprising
      A) a single chain Fv domain (scFv) that binds human CTLA-4, wherein said scFv domain comprises:
         1) a first variable heavy domain (VH1);
         2) a scFv linker; and
         3) a first variable light domain (VL1); and
      B) a first variant Fc domain;
   ii) a second monomer comprising a VH2-CH1-hinge-CH2-CH3 heavy chain, wherein VH2 is a second variable heavy domain and CH2-CH3 is a second variant Fc domain; and
   c) a light chain comprising a second variable light domain (VL2) and a constant light domain (CL);
wherein said VH2 and said VL2 bind LAG-3,
wherein said first monomer comprises SEQ ID NO:35612, said second monomer comprises SEQ ID NO:35607 and said light chain comprises SEQ ID NO:35622.

4. A method for treating cancer comprising administering to a patient in need thereof:
   a) a heterodimeric bispecific antibody comprising:
      i) a first monomer comprising SEQ ID NO:35612;
      ii) a second monomer comprising SEQ ID NO:35607; and
      iii) a light chain comprising SEQ ID NO:35622; and
   b) an anti-PD-1 antibody.

* * * * *

UNITED STATES PATENT AND TRADEMARK OFFICE
CERTIFICATE OF CORRECTION

PATENT NO. : 11,312,770 B2
APPLICATION NO. : 16/184895
DATED : April 26, 2022
INVENTOR(S) : Bernett et al.

Page 1 of 1

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 238 days.

Signed and Sealed this
Eighteenth Day of February, 2025

Coke Morgan Stewart
*Acting Director of the United States Patent and Trademark Office*